United States Patent 12,371,699 (NUCLEIC ACIDS ENCODING CRISPR-ASSOCIATED PROTEINS AND USES THEREOF) - sequence listing, part 13

SEQ ID NO: 9859 - RNA, 3582 nt, synthetic construct
  misc_feature 1..3582: note = Cas9 variant mRNA product
  source 1..3582: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9860 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9861 - RNA, 3666 nt, synthetic construct
  misc_feature 1..3666: note = Cas9 variant mRNA product
  source 1..3666: mol_type = other RNA
gggagagtccgctcagccaggttgcagaagcggcttagcgtgtgtcctaatcttctctctgcgtgtaggtaggcctgtgccgcaaacaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9862 - RNA, 3366 nt, synthetic construct
  misc_feature 1..3366: note = Cas9 variant mRNA product
  source 1..3366: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9863 - RNA, 3777 nt, synthetic construct
  misc_feature 1..3777: note = Cas9 variant mRNA product
  source 1..3777: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9864 - RNA, 4335 nt, synthetic construct
  misc_feature 1..4335: note = Cpf1 variant mRNA product
  source 1..4335: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9865 - RNA, 4314 nt, synthetic construct
  misc_feature 1..4314: note = Cpf1 variant mRNA product
  source 1..4314: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9866 - RNA, 4518 nt, synthetic construct
  misc_feature 1..4518: note = Cas9 variant mRNA product
  source 1..4518: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9867 - RNA, 5301 nt, synthetic construct
  misc_feature 1..5301: note = Cas9 variant mRNA product
  source 1..5301: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9868 - RNA, 3573 nt, synthetic construct
  misc_feature 1..3573: note = Cas9 variant mRNA product
  source 1..3573: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9869 - RNA, 4641 nt, synthetic construct
  misc_feature 1..4641: note = Cas9 variant mRNA product
  source 1..4641: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9870 - RNA, 3717 nt, synthetic construct
  misc_feature 1..3717: note = Cas9 variant mRNA product
  source 1..3717: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9871 - RNA, 4578 nt, synthetic construct
  misc_feature 1..4578: note = Cas9 variant mRNA product
  source 1..4578: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9872 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9873 - RNA, 4416 nt, synthetic construct
  misc_feature 1..4416: note = Cas9 variant mRNA product
  source 1..4416: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9874 - RNA, 4449 nt, synthetic construct
  misc_feature 1..4449: note = Cas9 variant mRNA product
  source 1..4449: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9875 - RNA, 3582 nt, synthetic construct
  misc_feature 1..3582: note = Cas9 variant mRNA product
  source 1..3582: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9876 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9877 - RNA, 3666 nt, synthetic construct
  misc_feature 1..3666: note = Cas9 variant mRNA product
  source 1..3666: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9878 - RNA, 3366 nt, synthetic construct
  misc_feature 1..3366: note = Cas9 variant mRNA product
  source 1..3366: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9879 - RNA, 3777 nt, synthetic construct
  misc_feature 1..3777: note = Cas9 variant mRNA product
  source 1..3777: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9880 - RNA, 4335 nt, synthetic construct
  misc_feature 1..4335: note = Cpf1 variant mRNA product
  source 1..4335: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9881 - RNA, 4314 nt, synthetic construct
  misc_feature 1..4314: note = Cpf1 variant mRNA product
  source 1..4314: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9882 - RNA, 4518 nt, synthetic construct
  misc_feature 1..4518: note = Cas9 variant mRNA product
  source 1..4518: mol_type = other RNA
gggagagtccgctcagccaggttgcagaagcggcttagcgtgtgtcctaatcttctctctgcgtgtaggtaggcctgtgccgcaaacaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9883 - RNA, 5301 nt, synthetic construct
  misc_feature 1..5301: note = Cas9 variant mRNA product
  source 1..5301: mol_type = other RNA
gggagagtccgctcagccaggttgcagaagcggcttagcgtgtgtcctaatcttctctctgcgtgtaggtaggcctgtgccgcaaacaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9884 - RNA, 3573 nt, synthetic construct
  misc_feature 1..3573: note = Cas9 variant mRNA product
  source 1..3573: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9885 - RNA, 4641 nt, synthetic construct
  misc_feature 1..4641: note = Cas9 variant mRNA product
  source 1..4641: mol_type = other RNA
gggagagtccgctcagccaggttgcagaagcggcttagcgtgtgtcctaatcttctctctgcgtgtaggtaggcctgtgccgcaaacaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9886 - RNA, 3717 nt, synthetic construct
  misc_feature 1..3717: note = Cas9 variant mRNA product
  source 1..3717: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9887 - RNA, 4578 nt, synthetic construct
  misc_feature 1..4578: note = Cas9 variant mRNA product
  source 1..4578: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9888 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9889 - RNA, 4416 nt, synthetic construct
  misc_feature 1..4416: note = Cas9 variant mRNA product
  source 1..4416: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9890 - RNA, 4449 nt, synthetic construct
  misc_feature 1..4449: note = Cas9 variant mRNA product
  source 1..4449: mol_type = other RNA
gggagagtccgctcagccaggttgcagaagcggcttagcgtgtgtcctaatcttctctctgcgtgtaggtaggcctgtgccgcaaacaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9891 - RNA, 3582 nt, synthetic construct
  misc_feature 1..3582: note = Cas9 variant mRNA product
  source 1..3582: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9892 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9893 - RNA, 3666 nt, synthetic construct
  misc_feature 1..3666: note = Cas9 variant mRNA product
  source 1..3666: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9894 - RNA, 3366 nt, synthetic construct
  misc_feature 1..3366: note = Cas9 variant mRNA product
  source 1..3366: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9895 - RNA, 3777 nt, synthetic construct
  misc_feature 1..3777: note = Cas9 variant mRNA product
  source 1..3777: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9896 - RNA, 4335 nt, synthetic construct
  misc_feature 1..4335: note = Cpf1 variant mRNA product
  source 1..4335: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9897 - RNA, 4314 nt, synthetic construct
  misc_feature 1..4314: note = Cpf1 variant mRNA product
  source 1..4314: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9898 - RNA, 4518 nt, synthetic construct
  misc_feature 1..4518: note = Cas9 variant mRNA product
  source 1..4518: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9899 - RNA, 5301 nt, synthetic construct
  misc_feature 1..5301: note = Cas9 variant mRNA product
  source 1..5301: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9900 - RNA, 3573 nt, synthetic construct
  misc_feature 1..3573: note = Cas9 variant mRNA product
  source 1..3573: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9901 - RNA, 4641 nt, synthetic construct
  misc_feature 1..4641: note = Cas9 variant mRNA product
  source 1..4641: mol_type = other RNA
gggagagtccgctcagccaggttgcagaagcggcttagcgtgtgtcctaatcttctctctgcgtgtaggtaggcctgtgccgcaaacaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9902 - RNA, 3717 nt, synthetic construct
  misc_feature 1..3717: note = Cas9 variant mRNA product
  source 1..3717: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9903 - RNA, 4578 nt, synthetic construct
  misc_feature 1..4578: note = Cas9 variant mRNA product
  source 1..4578: mol_type = other RNA
gggagagtccgctcagccaggttgcagaagcggcttagcgtgtgtcctaatcttctctctgcgtgtaggtaggcctgtgccgcaaacaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9904 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9905 - RNA, 4416 nt, synthetic construct
  misc_feature 1..4416: note = Cas9 variant mRNA product
  source 1..4416: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9906 - RNA, 4449 nt, synthetic construct
  misc_feature 1..4449: note = Cas9 variant mRNA product
  source 1..4449: mol_type = other RNA
gggagagtccgctcagccaggttgcagaagcggcttagcgtgtgtcctaatcttctctctgcgtgtaggtaggcctgtgccgcaaacaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9907 - RNA, 3582 nt, synthetic construct
  misc_feature 1..3582: note = Cas9 variant mRNA product
  source 1..3582: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9908 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9909 - RNA, 3666 nt, synthetic construct
  misc_feature 1..3666: note = Cas9 variant mRNA product
  source 1..3666: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9910 - RNA, 3366 nt, synthetic construct
  misc_feature 1..3366: note = Cas9 variant mRNA product
  source 1..3366: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9911 - RNA, 3777 nt, synthetic construct
  misc_feature 1..3777: note = Cas9 variant mRNA product
  source 1..3777: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9912 - RNA, 4335 nt, synthetic construct
  misc_feature 1..4335: note = Cpf1 variant mRNA product
  source 1..4335: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9913 - RNA, 4314 nt, synthetic construct
  misc_feature 1..4314: note = Cpf1 variant mRNA product
  source 1..4314: mol_type = other RNA
gggagagtccgctcagccaggttgcagaagcggcttagcgtgtgtcctaatcttctctctgcgtgtaggtaggcctgtgccgcaaacaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9914 - RNA, 4518 nt, synthetic construct
  misc_feature 1..4518: note = Cas9 variant mRNA product
  source 1..4518: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9915 - RNA, 5301 nt, synthetic construct
  misc_feature 1..5301: note = Cas9 variant mRNA product
  source 1..5301: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9916 - RNA, 3573 nt, synthetic construct
  misc_feature 1..3573: note = Cas9 variant mRNA product
  source 1..3573: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9917 - RNA, 4641 nt, synthetic construct
  misc_feature 1..4641: note = Cas9 variant mRNA product
  source 1..4641: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9918 - RNA, 3717 nt, synthetic construct
  misc_feature 1..3717: note = Cas9 variant mRNA product
  source 1..3717: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9919 - RNA, 4578 nt, synthetic construct
  misc_feature 1..4578: note = Cas9 variant mRNA product
  source 1..4578: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9920 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9921 - RNA, 4416 nt, synthetic construct
  misc_feature 1..4416: note = Cas9 variant mRNA product
  source 1..4416: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9922 - RNA, 4449 nt, synthetic construct
  misc_feature 1..4449: note = Cas9 variant mRNA product
  source 1..4449: mol_type = other RNA
gggagagtccgctcagccaggttgcagaagcggcttagcgtgtgtcctaatcttctctctgcgtgtaggtaggcctgtgccgcaaacaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9923 - RNA, 3582 nt, synthetic construct
  misc_feature 1..3582: note = Cas9 variant mRNA product
  source 1..3582: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9924 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9925 - RNA, 3666 nt, synthetic construct
  misc_feature 1..3666: note = Cas9 variant mRNA product
  source 1..3666: mol_type = other RNA
gggagagtccgctcagccaggttgcagaagcggcttagcgtgtgtcctaatcttctctctgcgtgtaggtaggcctgtgccgcaaacaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9926 - RNA, 3366 nt, synthetic construct
  misc_feature 1..3366: note = Cas9 variant mRNA product
  source 1..3366: mol_type = other RNA
gggagagtccgctcagccaggttgcagaagcggcttagcgtgtgtcctaatcttctctctgcgtgtaggtaggcctgtgccgcaaacaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9927 - RNA, 3777 nt, synthetic construct
  misc_feature 1..3777: note = Cas9 variant mRNA product
  source 1..3777: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9928 - RNA, 4335 nt, synthetic construct
  misc_feature 1..4335: note = Cpf1 variant mRNA product
  source 1..4335: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9929 - RNA, 4314 nt, synthetic construct
  misc_feature 1..4314: note = Cpf1 variant mRNA product
  source 1..4314: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9930 - RNA, 4518 nt, synthetic construct
  misc_feature 1..4518: note = Cas9 variant mRNA product
  source 1..4518: mol_type = other RNA
gggagagtccgctcagccaggttgcagaagcggcttagcgtgtgtcctaatcttctctctgcgtgtaggtaggcctgtgccgcaaacaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9931 - RNA, 5301 nt, synthetic construct
  misc_feature 1..5301: note = Cas9 variant mRNA product
  source 1..5301: mol_type = other RNA
gggagagtccgctcagccaggttgcagaagcggcttagcgtgtgtcctaatcttctctctgcgtgtaggtaggcctgtgccgcaaacaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9932 - RNA, 3573 nt, synthetic construct
  misc_feature 1..3573: note = Cas9 variant mRNA product
  source 1..3573: mol_type = other RNA
gggagagtccgctcagccaggttgcagaagcggcttagcgtgtgtcctaatcttctctctgcgtgtaggtaggcctgtgccgcaaacaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9933 - RNA, 4641 nt, synthetic construct
  misc_feature 1..4641: note = Cas9 variant mRNA product
  source 1..4641: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9934 - RNA, 3717 nt, synthetic construct
  misc_feature 1..3717: note = Cas9 variant mRNA product
  source 1..3717: mol_type = other RNA
gggagagtccgctcagccaggttgcagaagcggcttagcgtgtgtcctaatcttctctctgcgtgtaggtaggcctgtgccgcaaacaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9935 - RNA, 4578 nt, synthetic construct
  misc_feature 1..4578: note = Cas9 variant mRNA product
  source 1..4578: mol_type = other RNA
gggagagtccgctcagccaggttgcagaagcggcttagcgtgtgtcctaatcttctctctgcgtgtaggtaggcctgtgccgcaaacaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9936 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9937 - RNA, 4416 nt, synthetic construct
  misc_feature 1..4416: note = Cas9 variant mRNA product
  source 1..4416: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9938 - RNA, 4449 nt, synthetic construct
  misc_feature 1..4449: note = Cas9 variant mRNA product
  source 1..4449: mol_type = other RNA
gggagagtccgctcagccaggttgcagaagcggcttagcgtgtgtcctaatcttctctctgcgtgtaggtaggcctgtgccgcaaacaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9939 - RNA, 3582 nt, synthetic construct
  misc_feature 1..3582: note = Cas9 variant mRNA product
  source 1..3582: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9940 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9941 - RNA, 3666 nt, synthetic construct
  misc_feature 1..3666: note = Cas9 variant mRNA product
  source 1..3666: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9942 - RNA, 3366 nt, synthetic construct
  misc_feature 1..3366: note = Cas9 variant mRNA product
  source 1..3366: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9943 - RNA, 3777 nt, synthetic construct
  misc_feature 1..3777: note = Cas9 variant mRNA product
  source 1..3777: mol_type = other RNA
gggagagtccgctcagccaggttgcagaagcggcttagcgtgtgtcctaatcttctctctgcgtgtaggtaggcctgtgccgcaaacaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9944 - RNA, 4335 nt, synthetic construct
  misc_feature 1..4335: note = Cpf1 variant mRNA product
  source 1..4335: mol_type = other RNA
gggagagtccgctcagccaggttgcagaagcggcttagcgtgtgtcctaatcttctctctgcgtgtaggtaggcctgtgccgcaaacaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9945 - RNA, 4314 nt, synthetic construct
  misc_feature 1..4314: note = Cpf1 variant mRNA product
  source 1..4314: mol_type = other RNA
gggagagtccgctcagccaggttgcagaagcggcttagcgtgtgtcctaatcttctctctgcgtgtaggtaggcctgtgccgcaaacaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9946 - RNA, 4548 nt, synthetic construct
  misc_feature 1..4548: note = Cas9 variant mRNA product
  source 1..4548: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9947 - RNA, 5331 nt, synthetic construct
  misc_feature 1..5331: note = Cas9 variant mRNA product
  source 1..5331: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9948 - RNA, 3603 nt, synthetic construct
  misc_feature 1..3603: note = Cas9 variant mRNA product
  source 1..3603: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9949 - RNA, 4671 nt, synthetic construct
  misc_feature 1..4671: note = Cas9 variant mRNA product
  source 1..4671: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9950 - RNA, 3747 nt, synthetic construct
  misc_feature 1..3747: note = Cas9 variant mRNA product
  source 1..3747: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9951 - RNA, 4608 nt, synthetic construct
  misc_feature 1..4608: note = Cas9 variant mRNA product
  source 1..4608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9952 - RNA, 3690 nt, synthetic construct
  misc_feature 1..3690: note = Cas9 variant mRNA product
  source 1..3690: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9953 - RNA, 4446 nt, synthetic construct
  misc_feature 1..4446: note = Cas9 variant mRNA product
  source 1..4446: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9954 - RNA, 4479 nt, synthetic construct
  misc_feature 1..4479: note = Cas9 variant mRNA product
  source 1..4479: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9955 - RNA, 3612 nt, synthetic construct
  misc_feature 1..3612: note = Cas9 variant mRNA product
  source 1..3612: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9956 - RNA, 3690 nt, synthetic construct
  misc_feature 1..3690: note = Cas9 variant mRNA product
  source 1..3690: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9957 - RNA, 3696 nt, synthetic construct
  misc_feature 1..3696: note = Cas9 variant mRNA product
  source 1..3696: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9958 - RNA, 3396 nt, synthetic construct
  misc_feature 1..3396: note = Cas9 variant mRNA product
  source 1..3396: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9959 - RNA, 3807 nt, synthetic construct
  misc_feature 1..3807: note = Cas9 variant mRNA product
  source 1..3807: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9960 - RNA, 4365 nt, synthetic construct
  misc_feature 1..4365: note = Cpf1 variant mRNA product
  source 1..4365: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9961 - RNA, 4344 nt, synthetic construct
  misc_feature 1..4344: note = Cpf1 variant mRNA product
  source 1..4344: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9962 - RNA, 4545 nt, synthetic construct
  misc_feature 1..4545: note = Cas9 variant mRNA product
  source 1..4545: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9963 - RNA, 5328 nt, synthetic construct
  misc_feature 1..5328: note = Cas9 variant mRNA product
  source 1..5328: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9964 - RNA, 3600 nt, synthetic construct
  misc_feature 1..3600: note = Cas9 variant mRNA product
  source 1..3600: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9965 - RNA, 4668 nt, synthetic construct
  misc_feature 1..4668: note = Cas9 variant mRNA product
  source 1..4668: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9966 - RNA, 3744 nt, synthetic construct
  misc_feature 1..3744: note = Cas9 variant mRNA product
  source 1..3744: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9967 - RNA, 4605 nt, synthetic construct
  misc_feature 1..4605: note = Cas9 variant mRNA product
  source 1..4605: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9968 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9969 - RNA, 4443 nt, synthetic construct
  misc_feature 1..4443: note = Cas9 variant mRNA product
  source 1..4443: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9970 - RNA, 4476 nt, synthetic construct
  misc_feature 1..4476: note = Cas9 variant mRNA product
  source 1..4476: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9971 - RNA, 3609 nt, synthetic construct
  misc_feature 1..3609: note = Cas9 variant mRNA product
  source 1..3609: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9972 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9973 - RNA, 3693 nt, synthetic construct
  misc_feature 1..3693: note = Cas9 variant mRNA product
  source 1..3693: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9974 - RNA, 3393 nt, synthetic construct
  misc_feature 1..3393: note = Cas9 variant mRNA product
  source 1..3393: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9975 - RNA, 3804 nt, synthetic construct
  misc_feature 1..3804: note = Cas9 variant mRNA product
  source 1..3804: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9976 - RNA, 4362 nt, synthetic construct
  misc_feature 1..4362: note = Cpf1 variant mRNA product
  source 1..4362: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9977 - RNA, 4341 nt, synthetic construct
  misc_feature 1..4341: note = Cpf1 variant mRNA product
  source 1..4341: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9978 - RNA, 4545 nt, synthetic construct
  misc_feature 1..4545: note = Cas9 variant mRNA product
  source 1..4545: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9979 - RNA, 5328 nt, synthetic construct
  misc_feature 1..5328: note = Cas9 variant mRNA product
  source 1..5328: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9980 - RNA, 3600 nt, synthetic construct
  misc_feature 1..3600: note = Cas9 variant mRNA product
  source 1..3600: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9981 - RNA, 4668 nt, synthetic construct
  misc_feature 1..4668: note = Cas9 variant mRNA product
  source 1..4668: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9982 - RNA, 3744 nt, synthetic construct
  misc_feature 1..3744: note = Cas9 variant mRNA product
  source 1..3744: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9983 - RNA, 4605 nt, synthetic construct
  misc_feature 1..4605: note = Cas9 variant mRNA product
  source 1..4605: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9984 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9985 - RNA, 4443 nt, synthetic construct
  misc_feature 1..4443: note = Cas9 variant mRNA product
  source 1..4443: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9986 - RNA, 4476 nt, synthetic construct
  misc_feature 1..4476: note = Cas9 variant mRNA product
  source 1..4476: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9987 - RNA, 3609 nt, synthetic construct
  misc_feature 1..3609: note = Cas9 variant mRNA product
  source 1..3609: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9988 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9989 - RNA, 3693 nt, synthetic construct
  misc_feature 1..3693: note = Cas9 variant mRNA product
  source 1..3693: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9990 - RNA, 3393 nt, synthetic construct
  misc_feature 1..3393: note = Cas9 variant mRNA product
  source 1..3393: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9991 - RNA, 3804 nt, synthetic construct
  misc_feature 1..3804: note = Cas9 variant mRNA product
  source 1..3804: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9992 - RNA, 4362 nt, synthetic construct
  misc_feature 1..4362: note = Cpf1 variant mRNA product
  source 1..4362: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9993 - RNA, 4341 nt, synthetic construct
  misc_feature 1..4341: note = Cpf1 variant mRNA product
  source 1..4341: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9994 - RNA, 4545 nt, synthetic construct
  misc_feature 1..4545: note = Cas9 variant mRNA product
  source 1..4545: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9995 - RNA, 5328 nt, synthetic construct
  misc_feature 1..5328: note = Cas9 variant mRNA product
  source 1..5328: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9996 - RNA, 3600 nt, synthetic construct
  misc_feature 1..3600: note = Cas9 variant mRNA product
  source 1..3600: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9997 - RNA, 4668 nt, synthetic construct
  misc_feature 1..4668: note = Cas9 variant mRNA product
  source 1..4668: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9998 - RNA, 3744 nt, synthetic construct
  misc_feature 1..3744: note = Cas9 variant mRNA product
  source 1..3744: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9999 - RNA, 4605 nt, synthetic construct
  misc_feature 1..4605: note = Cas9 variant mRNA product
  source 1..4605: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10000 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10001 - RNA, 4443 nt, synthetic construct
  misc_feature 1..4443: note = Cas9 variant mRNA product
  source 1..4443: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10002 - RNA, 4476 nt, synthetic construct
  misc_feature 1..4476: note = Cas9 variant mRNA product
  source 1..4476: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10003 - RNA, 3609 nt, synthetic construct
  misc_feature 1..3609: note = Cas9 variant mRNA product
  source 1..3609: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10004 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10005 - RNA, 3693 nt, synthetic construct
  misc_feature 1..3693: note = Cas9 variant mRNA product
  source 1..3693: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10006 - RNA, 3393 nt, synthetic construct
  misc_feature 1..3393: note = Cas9 variant mRNA product
  source 1..3393: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10007 - RNA, 3804 nt, synthetic construct
  misc_feature 1..3804: note = Cas9 variant mRNA product
  source 1..3804: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10008 - RNA, 4362 nt, synthetic construct
  misc_feature 1..4362: note = Cpf1 variant mRNA product
  source 1..4362: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10009 - RNA, 4341 nt, synthetic construct
  misc_feature 1..4341: note = Cpf1 variant mRNA product
  source 1..4341: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10010 - RNA, 4545 nt, synthetic construct
  misc_feature 1..4545: note = Cas9 variant mRNA product
  source 1..4545: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10011 - RNA, 5328 nt, synthetic construct
  misc_feature 1..5328: note = Cas9 variant mRNA product
  source 1..5328: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10012 - RNA, 3600 nt, synthetic construct
  misc_feature 1..3600: note = Cas9 variant mRNA product
  source 1..3600: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10013 - RNA, 4668 nt, synthetic construct
  misc_feature 1..4668: note = Cas9 variant mRNA product
  source 1..4668: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10014 - RNA, 3744 nt, synthetic construct
  misc_feature 1..3744: note = Cas9 variant mRNA product
  source 1..3744: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10015 - RNA, 4605 nt, synthetic construct
  misc_feature 1..4605: note = Cas9 variant mRNA product
  source 1..4605: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10016 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10017 - RNA, 4443 nt, synthetic construct
  misc_feature 1..4443: note = Cas9 variant mRNA product
  source 1..4443: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10018 - RNA, 4476 nt, synthetic construct
  misc_feature 1..4476: note = Cas9 variant mRNA product
  source 1..4476: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10019 - RNA, 3609 nt, synthetic construct
  misc_feature 1..3609: note = Cas9 variant mRNA product
  source 1..3609: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10020 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10021 - RNA, 3693 nt, synthetic construct
  misc_feature 1..3693: note = Cas9 variant mRNA product
  source 1..3693: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10022 - RNA, 3393 nt, synthetic construct
  misc_feature 1..3393: note = Cas9 variant mRNA product
  source 1..3393: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10023 - RNA, 3804 nt, synthetic construct
  misc_feature 1..3804: note = Cas9 variant mRNA product
  source 1..3804: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10024 - RNA, 4362 nt, synthetic construct
  misc_feature 1..4362: note = Cpf1 variant mRNA product
  source 1..4362: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10025 - RNA, 4341 nt, synthetic construct
  misc_feature 1..4341: note = Cpf1 variant mRNA product
  source 1..4341: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10026 - RNA, 4545 nt, synthetic construct
  misc_feature 1..4545: note = Cas9 variant mRNA product
  source 1..4545: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10027 - RNA, 5328 nt, synthetic construct
  misc_feature 1..5328: note = Cas9 variant mRNA product
  source 1..5328: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10028 - RNA, 3600 nt, synthetic construct
  misc_feature 1..3600: note = Cas9 variant mRNA product
  source 1..3600: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10029 - RNA, 4668 nt, synthetic construct
  misc_feature 1..4668: note = Cas9 variant mRNA product
  source 1..4668: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10030 - RNA, 3744 nt, synthetic construct
  misc_feature 1..3744: note = Cas9 variant mRNA product
  source 1..3744: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10031 - RNA, 4605 nt, synthetic construct
  misc_feature 1..4605: note = Cas9 variant mRNA product
  source 1..4605: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10032 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10033 - RNA, 4443 nt, synthetic construct
  misc_feature 1..4443: note = Cas9 variant mRNA product
  source 1..4443: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10034 - RNA, 4476 nt, synthetic construct
  misc_feature 1..4476: note = Cas9 variant mRNA product
  source 1..4476: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10035 - RNA, 3609 nt, synthetic construct
  misc_feature 1..3609: note = Cas9 variant mRNA product
  source 1..3609: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10036 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10037 - RNA, 3693 nt, synthetic construct
  misc_feature 1..3693: note = Cas9 variant mRNA product
  source 1..3693: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10038 - RNA, 3393 nt, synthetic construct
  misc_feature 1..3393: note = Cas9 variant mRNA product
  source 1..3393: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10039 - RNA, 3804 nt, synthetic construct
  misc_feature 1..3804: note = Cas9 variant mRNA product
  source 1..3804: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10040 - RNA, 4362 nt, synthetic construct
  misc_feature 1..4362: note = Cpf1 variant mRNA product
  source 1..4362: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10041 - RNA, 4341 nt, synthetic construct
  misc_feature 1..4341: note = Cpf1 variant mRNA product
  source 1..4341: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10042 - RNA, 4545 nt, synthetic construct
  misc_feature 1..4545: note = Cas9 variant mRNA product
  source 1..4545: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10043 - RNA, 5328 nt, synthetic construct
  misc_feature 1..5328: note = Cas9 variant mRNA product
  source 1..5328: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10044 - RNA, 3600 nt, synthetic construct
  misc_feature 1..3600: note = Cas9 variant mRNA product
  source 1..3600: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10045 - RNA, 4668 nt, synthetic construct
  misc_feature 1..4668: note = Cas9 variant mRNA product
  source 1..4668: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10046 - RNA, 3744 nt, synthetic construct
  misc_feature 1..3744: note = Cas9 variant mRNA product
  source 1..3744: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10047 - RNA, 4605 nt, synthetic construct
  misc_feature 1..4605: note = Cas9 variant mRNA product
  source 1..4605: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10048 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10049 - RNA, 4443 nt, synthetic construct
  misc_feature 1..4443: note = Cas9 variant mRNA product
  source 1..4443: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10050 - RNA, 4476 nt, synthetic construct
  misc_feature 1..4476: note = Cas9 variant mRNA product
  source 1..4476: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10051 - RNA, 3609 nt, synthetic construct
  misc_feature 1..3609: note = Cas9 variant mRNA product
  source 1..3609: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10052 - RNA, 3687 nt, synthetic construct
  misc_feature 1..3687: note = Cas9 variant mRNA product
  source 1..3687: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10053 - RNA, 3693 nt, synthetic construct
  misc_feature 1..3693: note = Cas9 variant mRNA product
  source 1..3693: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10054 - RNA, 3393 nt, synthetic construct
  misc_feature 1..3393: note = Cas9 variant mRNA product
  source 1..3393: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10055 - RNA, 3804 nt, synthetic construct
  misc_feature 1..3804: note = Cas9 variant mRNA product
  source 1..3804: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10056 - RNA, 4362 nt, synthetic construct
  misc_feature 1..4362: note = Cpf1 variant mRNA product
  source 1..4362: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10057 - RNA, 4341 nt, synthetic construct
  misc_feature 1..4341: note = Cpf1 variant mRNA product
  source 1..4341: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10058 - RNA, 4744 nt, synthetic construct
  misc_feature 1..4744: note = Cas9 variant mRNA product
  source 1..4744: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10059 - RNA, 5527 nt, synthetic construct
  misc_feature 1..5527: note = Cas9 variant mRNA product
  source 1..5527: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10060 - RNA, 3799 nt, synthetic construct
  misc_feature 1..3799: note = Cas9 variant mRNA product
  source 1..3799: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10061 - RNA, 4867 nt, synthetic construct
  misc_feature 1..4867: note = Cas9 variant mRNA product
  source 1..4867: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10062 - RNA, 3943 nt, synthetic construct
  misc_feature 1..3943: note = Cas9 variant mRNA product
  source 1..3943: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10063 - RNA, 4804 nt, synthetic construct
  misc_feature 1..4804: note = Cas9 variant mRNA product
  source 1..4804: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10064 - RNA, 3886 nt, synthetic construct
  misc_feature 1..3886: note = Cas9 variant mRNA product
  source 1..3886: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10065 - RNA, 4642 nt, synthetic construct
  misc_feature 1..4642: note = Cas9 variant mRNA product
  source 1..4642: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10066 - RNA, 4675 nt, synthetic construct
  misc_feature 1..4675: note = Cas9 variant mRNA product
  source 1..4675: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10067 - RNA, 3808 nt, synthetic construct
  misc_feature 1..3808: note = Cas9 variant mRNA product
  source 1..3808: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10068 - RNA, 3886 nt, synthetic construct
  misc_feature 1..3886: note = Cas9 variant mRNA product
  source 1..3886: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10069 - RNA, 3892 nt, synthetic construct
  misc_feature 1..3892: note = Cas9 variant mRNA product
  source 1..3892: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10070 - RNA, 3592 nt, synthetic construct
  misc_feature 1..3592: note = Cas9 variant mRNA product
  source 1..3592: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10071 - RNA, 4003 nt, synthetic construct
  misc_feature 1..4003: note = Cas9 variant mRNA product
  source 1..4003: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10072 - RNA, 4561 nt, synthetic construct
  misc_feature 1..4561: note = Cpf1 variant mRNA product
  source 1..4561: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10073 - RNA, 4540 nt, synthetic construct
  misc_feature 1..4540: note = Cpf1 variant mRNA product
  source 1..4540: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10074 - RNA, 4741 nt, synthetic construct
  misc_feature 1..4741: note = Cas9 variant mRNA product
  source 1..4741: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10075 - RNA, 5524 nt, synthetic construct
  misc_feature 1..5524: note = Cas9 variant mRNA product
  source 1..5524: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10076 - RNA, 3796 nt, synthetic construct
  misc_feature 1..3796: note = Cas9 variant mRNA product
  source 1..3796: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10077 - RNA, 4864 nt, synthetic construct
  misc_feature 1..4864: note = Cas9 variant mRNA product
  source 1..4864: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10078 - RNA, 3940 nt, synthetic construct
  misc_feature 1..3940: note = Cas9 variant mRNA product
  source 1..3940: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10079 - RNA, 4801 nt, synthetic construct
  misc_feature 1..4801: note = Cas9 variant mRNA product
  source 1..4801: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10080 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10081 - RNA, 4639 nt, synthetic construct
  misc_feature 1..4639: note = Cas9 variant mRNA product
  source 1..4639: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10082 - RNA, 4672 nt, synthetic construct
  misc_feature 1..4672: note = Cas9 variant mRNA product
  source 1..4672: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10083 - RNA, 3805 nt, synthetic construct
  misc_feature 1..3805: note = Cas9 variant mRNA product
  source 1..3805: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10084 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10085 - RNA, 3889 nt, synthetic construct
  misc_feature 1..3889: note = Cas9 variant mRNA product
  source 1..3889: mol_type = other RNA
gggagacccgtgacccggaagttgtacggctacgcgactttccctcccacaaaccctcgcgcccttcctttcctacttgggcccggcagaaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10086 - RNA, 3589 nt, synthetic construct
  misc_feature 1..3589: note = Cas9 variant mRNA product
  source 1..3589: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10087 - RNA, 4000 nt, synthetic construct
  misc_feature 1..4000: note = Cas9 variant mRNA product
  source 1..4000: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10088 - RNA, 4558 nt, synthetic construct
  misc_feature 1..4558: note = Cpf1 variant mRNA product
  source 1..4558: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10089 - RNA, 4537 nt, synthetic construct
  misc_feature 1..4537: note = Cpf1 variant mRNA product
  source 1..4537: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10090 - RNA, 4741 nt, synthetic construct
  misc_feature 1..4741: note = Cas9 variant mRNA product
  source 1..4741: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10091 - RNA, 5524 nt, synthetic construct
  misc_feature 1..5524: note = Cas9 variant mRNA product
  source 1..5524: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10092 - RNA, 3796 nt, synthetic construct
  misc_feature 1..3796: note = Cas9 variant mRNA product
  source 1..3796: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10093 - RNA, 4864 nt, synthetic construct
  misc_feature 1..4864: note = Cas9 variant mRNA product
  source 1..4864: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10094 - RNA, 3940 nt, synthetic construct
  misc_feature 1..3940: note = Cas9 variant mRNA product
  source 1..3940: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10095 - RNA, 4801 nt, synthetic construct
  misc_feature 1..4801: note = Cas9 variant mRNA product
  source 1..4801: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10096 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10097 - RNA, 4639 nt, synthetic construct
  misc_feature 1..4639: note = Cas9 variant mRNA product
  source 1..4639: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10098 - RNA, 4672 nt, synthetic construct
  misc_feature 1..4672: note = Cas9 variant mRNA product
  source 1..4672: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10099 - RNA, 3805 nt, synthetic construct
  misc_feature 1..3805: note = Cas9 variant mRNA product
  source 1..3805: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10100 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10101 - RNA, 3889 nt, synthetic construct
  misc_feature 1..3889: note = Cas9 variant mRNA product
  source 1..3889: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10102 - RNA, 3589 nt, synthetic construct
  misc_feature 1..3589: note = Cas9 variant mRNA product
  source 1..3589: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10103 - RNA, 4000 nt, synthetic construct
  misc_feature 1..4000: note = Cas9 variant mRNA product
  source 1..4000: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10104 - RNA, 4558 nt, synthetic construct
  misc_feature 1..4558: note = Cpf1 variant mRNA product
  source 1..4558: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10105 - RNA, 4537 nt, synthetic construct
  misc_feature 1..4537: note = Cpf1 variant mRNA product
  source 1..4537: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10106 - RNA, 4741 nt, synthetic construct
  misc_feature 1..4741: note = Cas9 variant mRNA product
  source 1..4741: mol_type = other RNA
gggagacccgtgacccggaagttgtacggctacgcgactttccctcccacaaaccctcgcgcccttcctttcctacttgggcccggcagaaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10107 - RNA, 5524 nt, synthetic construct
  misc_feature 1..5524: note = Cas9 variant mRNA product
  source 1..5524: mol_type = other RNA
gggagacccgtgacccggaagttgtacggctacgcgactttccctcccacaaaccctcgcgcccttcctttcctacttgggcccggcagaaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10108 - RNA, 3796 nt, synthetic construct
  misc_feature 1..3796: note = Cas9 variant mRNA product
  source 1..3796: mol_type = other RNA
gggagacccgtgacccggaagttgtacggctacgcgactttccctcccacaaaccctcgcgcccttcctttcctacttgggcccggcagaaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10109 - RNA, 4864 nt, synthetic construct
  misc_feature 1..4864: note = Cas9 variant mRNA product
  source 1..4864: mol_type = other RNA
gggagacccgtgacccggaagttgtacggctacgcgactttccctcccacaaaccctcgcgcccttcctttcctacttgggcccggcagaaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10110 - RNA, 3940 nt, synthetic construct
  misc_feature 1..3940: note = Cas9 variant mRNA product
  source 1..3940: mol_type = other RNA
gggagacccgtgacccggaagttgtacggctacgcgactttccctcccacaaaccctcgcgcccttcctttcctacttgggcccggcagaaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10111 - RNA, 4801 nt, synthetic construct
  misc_feature 1..4801: note = Cas9 variant mRNA product
  source 1..4801: mol_type = other RNA
gggagacccgtgacccggaagttgtacggctacgcgactttccctcccacaaaccctcgcgcccttcctttcctacttgggcccggcagaaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10112 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10113 - RNA, 4639 nt, synthetic construct
  misc_feature 1..4639: note = Cas9 variant mRNA product
  source 1..4639: mol_type = other RNA
gggagacccgtgacccggaagttgtacggctacgcgactttccctcccacaaaccctcgcgcccttcctttcctacttgggcccggcagaaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10114 - RNA, 4672 nt, synthetic construct
  misc_feature 1..4672: note = Cas9 variant mRNA product
  source 1..4672: mol_type = other RNA
gggagacccgtgacccggaagttgtacggctacgcgactttccctcccacaaaccctcgcgcccttcctttcctacttgggcccggcagaaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10115 - RNA, 3805 nt, synthetic construct
  misc_feature 1..3805: note = Cas9 variant mRNA product
  source 1..3805: mol_type = other RNA
gggagacccgtgacccggaagttgtacggctacgcgactttccctcccacaaaccctcgcgcccttcctttcctacttgggcccggcagaaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10116 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10117 - RNA, 3889 nt, synthetic construct
  misc_feature 1..3889: note = Cas9 variant mRNA product
  source 1..3889: mol_type = other RNA
gggagacccgtgacccggaagttgtacggctacgcgactttccctcccacaaaccctcgcgcccttcctttcctacttgggcccggcagaaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10118 - RNA, 3589 nt, synthetic construct
  misc_feature 1..3589: note = Cas9 variant mRNA product
  source 1..3589: mol_type = other RNA
gggagacccgtgacccggaagttgtacggctacgcgactttccctcccacaaaccctcgcgcccttcctttcctacttgggcccggcagaaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10119 - RNA, 4000 nt, synthetic construct
  misc_feature 1..4000: note = Cas9 variant mRNA product
  source 1..4000: mol_type = other RNA
gggagacccgtgacccggaagttgtacggctacgcgactttccctcccacaaaccctcgcgcccttcctttcctacttgggcccggcagaaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10120 - RNA, 4558 nt, synthetic construct
  misc_feature 1..4558: note = Cpf1 variant mRNA product
  source 1..4558: mol_type = other RNA
gggagacccgtgacccggaagttgtacggctacgcgactttccctcccacaaaccctcgcgcccttcctttcctacttgggcccggcagaaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10121 - RNA, 4537 nt, synthetic construct
  misc_feature 1..4537: note = Cpf1 variant mRNA product
  source 1..4537: mol_type = other RNA
gggagacccgtgacccggaagttgtacggctacgcgactttccctcccacaaaccctcgcgcccttcctttcctacttgggcccggcagaaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10122 - RNA, 4741 nt, synthetic construct
  misc_feature 1..4741: note = Cas9 variant mRNA product
  source 1..4741: mol_type = other RNA
gggagacccgtgacccggaagttgtacggctacgcgactttccctcccacaaaccctcgcgcccttcctttcctacttgggcccggcagaaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10123 - RNA, 5524 nt, synthetic construct
  misc_feature 1..5524: note = Cas9 variant mRNA product
  source 1..5524: mol_type = other RNA
gggagacccgtgacccggaagttgtacggctacgcgactttccctcccacaaaccctcgcgcccttcctttcctacttgggcccggcagaaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10124 - RNA, 3796 nt, synthetic construct
  misc_feature 1..3796: note = Cas9 variant mRNA product
  source 1..3796: mol_type = other RNA
gggagacccgtgacccggaagttgtacggctacgcgactttccctcccacaaaccctcgcgcccttcctttcctacttgggcccggcagaaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10125 - RNA, 4864 nt, synthetic construct
  misc_feature 1..4864: note = Cas9 variant mRNA product
  source 1..4864: mol_type = other RNA
gggagacccgtgacccggaagttgtacggctacgcgactttccctcccacaaaccctcgcgcccttcctttcctacttgggcccggcagaaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10126 - RNA, 3940 nt, synthetic construct
  misc_feature 1..3940: note = Cas9 variant mRNA product
  source 1..3940: mol_type = other RNA
gggagacccgtgacccggaagttgtacggctacgcgactttccctcccacaaaccctcgcgcccttcctttcctacttgggcccggcagaaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10127 - RNA, 4801 nt, synthetic construct
  misc_feature 1..4801: note = Cas9 variant mRNA product
  source 1..4801: mol_type = other RNA
gggagacccgtgacccggaagttgtacggctacgcgactttccctcccacaaaccctcgcgcccttcctttcctacttgggcccggcagaaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10128 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10129 - RNA, 4639 nt, synthetic construct
  misc_feature 1..4639: note = Cas9 variant mRNA product
  source 1..4639: mol_type = other RNA
gggagacccgtgacccggaagttgtacggctacgcgactttccctcccacaaaccctcgcgcccttcctttcctacttgggcccggcagaaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10130 - RNA, 4672 nt, synthetic construct
  misc_feature 1..4672: note = Cas9 variant mRNA product
  source 1..4672: mol_type = other RNA
gggagacccgtgacccggaagttgtacggctacgcgactttccctcccacaaaccctcgcgcccttcctttcctacttgggcccggcagaaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10131 - RNA, 3805 nt, synthetic construct
  misc_feature 1..3805: note = Cas9 variant mRNA product
  source 1..3805: mol_type = other RNA
gggagacccgtgacccggaagttgtacggctacgcgactttccctcccacaaaccctcgcgcccttcctttcctacttgggcccggcagaaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10132 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10133 - RNA, 3889 nt, synthetic construct
  misc_feature 1..3889: note = Cas9 variant mRNA product
  source 1..3889: mol_type = other RNA
gggagacccgtgacccggaagttgtacggctacgcgactttccctcccacaaaccctcgcgcccttcctttcctacttgggcccggcagaaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10134 - RNA, 3589 nt, synthetic construct
  misc_feature 1..3589: note = Cas9 variant mRNA product
  source 1..3589: mol_type = other RNA
gggagacccgtgacccggaagttgtacggctacgcgactttccctcccacaaaccctcgcgcccttcctttcctacttgggcccggcagaaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10135 - RNA, 4000 nt, synthetic construct
  misc_feature 1..4000: note = Cas9 variant mRNA product
  source 1..4000: mol_type = other RNA
gggagacccgtgacccggaagttgtacggctacgcgactttccctcccacaaaccctcgcgcccttcctttcctacttgggcccggcagaaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10136 - RNA, 4558 nt, synthetic construct
  misc_feature 1..4558: note = Cpf1 variant mRNA product
  source 1..4558: mol_type = other RNA
gggagacccgtgacccggaagttgtacggctacgcgactttccctcccacaaaccctcgcgcccttcctttcctacttgggcccggcagaaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10137 - RNA, 4537 nt, synthetic construct
  misc_feature 1..4537: note = Cpf1 variant mRNA product
  source 1..4537: mol_type = other RNA
gggagacccgtgacccggaagttgtacggctacgcgactttccctcccacaaaccctcgcgcccttcctttcctacttgggcccggcagaaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10138 - RNA, 4741 nt, synthetic construct
  misc_feature 1..4741: note = Cas9 variant mRNA product
  source 1..4741: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10139 - RNA, 5524 nt, synthetic construct
  misc_feature 1..5524: note = Cas9 variant mRNA product
  source 1..5524: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10140 - RNA, 3796 nt, synthetic construct
  misc_feature 1..3796: note = Cas9 variant mRNA product
  source 1..3796: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10141 - RNA, 4864 nt, synthetic construct
  misc_feature 1..4864: note = Cas9 variant mRNA product
  source 1..4864: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10142 - RNA, 3940 nt, synthetic construct
  misc_feature 1..3940: note = Cas9 variant mRNA product
  source 1..3940: mol_type = other RNA
gggagacccgtgacccggaagttgtacggctacgcgactttccctcccacaaaccctcgcgcccttcctttcctacttgggcccggcagaaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10143 - RNA, 4801 nt, synthetic construct
  misc_feature 1..4801: note = Cas9 variant mRNA product
  source 1..4801: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10144 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10145 - RNA, 4639 nt, synthetic construct
  misc_feature 1..4639: note = Cas9 variant mRNA product
  source 1..4639: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10146 - RNA, 4672 nt, synthetic construct
  misc_feature 1..4672: note = Cas9 variant mRNA product
  source 1..4672: mol_type = other RNA
gggagacccgtgacccggaagttgtacggctacgcgactttccctcccacaaaccctcgcgcccttcctttcctacttgggcccggcagaaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10147 - RNA, 3805 nt, synthetic construct
  misc_feature 1..3805: note = Cas9 variant mRNA product
  source 1..3805: mol_type = other RNA
gggagacccgtgacccggaagttgtacggctacgcgactttccctcccacaaaccctcgcgcccttcctttcctacttgggcccggcagaaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10148 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10149 - RNA, 3889 nt, synthetic construct
  misc_feature 1..3889: note = Cas9 variant mRNA product
  source 1..3889: mol_type = other RNA
gggagacccgtgacccggaagttgtacggctacgcgactttccctcccacaaaccctcgcgcccttcctttcctacttgggcccggcagaaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10150 - RNA, 3589 nt, synthetic construct
  misc_feature 1..3589: note = Cas9 variant mRNA product
  source 1..3589: mol_type = other RNA
gggagacccgtgacccggaagttgtacggctacgcgactttccctcccacaaaccctcgcgcccttcctttcctacttgggcccggcagaaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10151 - RNA, 4000 nt, synthetic construct
  misc_feature 1..4000: note = Cas9 variant mRNA product
  source 1..4000: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10152 - RNA, 4558 nt, synthetic construct
  misc_feature 1..4558: note = Cpf1 variant mRNA product
  source 1..4558: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10153 - RNA, 4537 nt, synthetic construct
  misc_feature 1..4537: note = Cpf1 variant mRNA product
  source 1..4537: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10154 - RNA, 4741 nt, synthetic construct
  misc_feature 1..4741: note = Cas9 variant mRNA product
  source 1..4741: mol_type = other RNA
gggagacccgtgacccggaagttgtacggctacgcgactttccctcccacaaaccctcgcgcccttcctttcctacttgggcccggcagaaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10155 - RNA, 5524 nt, synthetic construct
  misc_feature 1..5524: note = Cas9 variant mRNA product
  source 1..5524: mol_type = other RNA
gggagacccgtgacccggaagttgtacggctacgcgactttccctcccacaaaccctcgcgcccttcctttcctacttgggcccggcagaaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10156 - RNA, 3796 nt, synthetic construct
  misc_feature 1..3796: note = Cas9 variant mRNA product
  source 1..3796: mol_type = other RNA
gggagacccgtgacccggaagttgtacggctacgcgactttccctcccacaaaccctcgcgcccttcctttcctacttgggcccggcagaaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10157 - RNA, 4864 nt, synthetic construct
  misc_feature 1..4864: note = Cas9 variant mRNA product
  source 1..4864: mol_type = other RNA
gggagacccgtgacccggaagttgtacggctacgcgactttccctcccacaaaccctcgcgcccttcctttcctacttgggcccggcagaaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10158 - RNA, 3940 nt, synthetic construct
  misc_feature 1..3940: note = Cas9 variant mRNA product
  source 1..3940: mol_type = other RNA
gggagacccgtgacccggaagttgtacggctacgcgactttccctcccacaaaccctcgcgcccttcctttcctacttgggcccggcagaaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10159 - RNA, 4801 nt, synthetic construct
  misc_feature 1..4801: note = Cas9 variant mRNA product
  source 1..4801: mol_type = other RNA
gggagacccgtgacccggaagttgtacggctacgcgactttccctcccacaaaccctcgcgcccttcctttcctacttgggcccggcagaaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10160 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10161 - RNA, 4639 nt, synthetic construct
  misc_feature 1..4639: note = Cas9 variant mRNA product
  source 1..4639: mol_type = other RNA
gggagacccgtgacccggaagttgtacggctacgcgactttccctcccacaaaccctcgcgcccttcctttcctacttgggcccggcagaaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10162 - RNA, 4672 nt, synthetic construct
  misc_feature 1..4672: note = Cas9 variant mRNA product
  source 1..4672: mol_type = other RNA
gggagacccgtgacccggaagttgtacggctacgcgactttccctcccacaaaccctcgcgcccttcctttcctacttgggcccggcagaaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10163 - RNA, 3805 nt, synthetic construct
  misc_feature 1..3805: note = Cas9 variant mRNA product
  source 1..3805: mol_type = other RNA
gggagacccgtgacccggaagttgtacggctacgcgactttccctcccacaaaccctcgcgcccttcctttcctacttgggcccggcagaaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10164 - RNA, 3883 nt, synthetic construct
  misc_feature 1..3883: note = Cas9 variant mRNA product
  source 1..3883: mol_type = other RNA
gggagacccgtgacccggaagttgtacggctacgcgactttccctcccacaaaccctcgcgcccttcctttcctacttgggcccggcagaaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10165 - RNA, 3889 nt, synthetic construct
  misc_feature 1..3889: note = Cas9 variant mRNA product
  source 1..3889: mol_type = other RNA
gggagacccgtgacccggaagttgtacggctacgcgactttccctcccacaaaccctcgcgcccttcctttcctacttgggcccggcagaaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10166 - RNA, 3589 nt, synthetic construct
  misc_feature 1..3589: note = Cas9 variant mRNA product
  source 1..3589: mol_type = other RNA
gggagacccgtgacccggaagttgtacggctacgcgactttccctcccacaaaccctcgcgcccttcctttcctacttgggcccggcagaaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10167 - RNA, 4000 nt, synthetic construct
  misc_feature 1..4000: note = Cas9 variant mRNA product
  source 1..4000: mol_type = other RNA
gggagacccgtgacccggaagttgtacggctacgcgactttccctcccacaaaccctcgcgcccttcctttcctacttgggcccggcagaaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10168 - RNA, 4558 nt, synthetic construct
  misc_feature 1..4558: note = Cpf1 variant mRNA product
  source 1..4558: mol_type = other RNA
gggagacccgtgacccggaagttgtacggctacgcgactttccctcccacaaaccctcgcgcccttcctttcctacttgggcccggcagaaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10169 - RNA, 4537 nt, synthetic construct
  misc_feature 1..4537: note = Cpf1 variant mRNA product
  source 1..4537: mol_type = other RNA
gggagacccgtgacccggaagttgtacggctacgcgactttccctcccacaaaccctcgcgcccttcctttcctacttgggcccggcagaaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10170 - RNA, 4479 nt, synthetic construct
  misc_feature 1..4479: note = Cas9 variant mRNA product
  source 1..4479: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10171 - RNA, 5262 nt, synthetic construct
  misc_feature 1..5262: note = Cas9 variant mRNA product
  source 1..5262: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10172 - RNA, 3534 nt, synthetic construct
  misc_feature 1..3534: note = Cas9 variant mRNA product
  source 1..3534: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10173 - RNA, 4602 nt, synthetic construct
  misc_feature 1..4602: note = Cas9 variant mRNA product
  source 1..4602: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10174 - RNA, 3678 nt, synthetic construct
  misc_feature 1..3678: note = Cas9 variant mRNA product
  source 1..3678: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10175 - RNA, 4539 nt, synthetic construct
  misc_feature 1..4539: note = Cas9 variant mRNA product
  source 1..4539: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10176 - RNA, 3621 nt, synthetic construct
  misc_feature 1..3621: note = Cas9 variant mRNA product
  source 1..3621: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10177 - RNA, 4377 nt, synthetic construct
  misc_feature 1..4377: note = Cas9 variant mRNA product
  source 1..4377: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10178 - RNA, 4410 nt, synthetic construct
  misc_feature 1..4410: note = Cas9 variant mRNA product
  source 1..4410: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10179 - RNA, 3543 nt, synthetic construct
  misc_feature 1..3543: note = Cas9 variant mRNA product
  source 1..3543: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10180 - RNA, 3621 nt, synthetic construct
  misc_feature 1..3621: note = Cas9 variant mRNA product
  source 1..3621: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10181 - RNA, 3627 nt, synthetic construct
  misc_feature 1..3627: note = Cas9 variant mRNA product
  source 1..3627: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10182 - RNA, 3327 nt, synthetic construct
  misc_feature 1..3327: note = Cas9 variant mRNA product
  source 1..3327: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10183 - RNA, 3738 nt, synthetic construct
  misc_feature 1..3738: note = Cas9 variant mRNA product
  source 1..3738: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10184 - RNA, 4296 nt, synthetic construct
  misc_feature 1..4296: note = Cpf1 variant mRNA product
  source 1..4296: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10185 - RNA, 4275 nt, synthetic construct
  misc_feature 1..4275: note = Cpf1 variant mRNA product
  source 1..4275: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10186 - RNA, 4476 nt, synthetic construct
  misc_feature 1..4476: note = Cas9 variant mRNA product
  source 1..4476: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10187 - RNA, 5259 nt, synthetic construct
  misc_feature 1..5259: note = Cas9 variant mRNA product
  source 1..5259: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10188 - RNA, 3531 nt, synthetic construct
  misc_feature 1..3531: note = Cas9 variant mRNA product
  source 1..3531: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10189 - RNA, 4599 nt, synthetic construct
  misc_feature 1..4599: note = Cas9 variant mRNA product
  source 1..4599: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10190 - RNA, 3675 nt, synthetic construct
  misc_feature 1..3675: note = Cas9 variant mRNA product
  source 1..3675: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10191 - RNA, 4536 nt, synthetic construct
  misc_feature 1..4536: note = Cas9 variant mRNA product
  source 1..4536: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10192 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10193 - RNA, 4374 nt, synthetic construct
  misc_feature 1..4374: note = Cas9 variant mRNA product
  source 1..4374: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10194 - RNA, 4407 nt, synthetic construct
  misc_feature 1..4407: note = Cas9 variant mRNA product
  source 1..4407: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10195 - RNA, 3540 nt, synthetic construct
  misc_feature 1..3540: note = Cas9 variant mRNA product
  source 1..3540: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10196 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10197 - RNA, 3624 nt, synthetic construct
  misc_feature 1..3624: note = Cas9 variant mRNA product
  source 1..3624: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10198 - RNA, 3324 nt, synthetic construct
  misc_feature 1..3324: note = Cas9 variant mRNA product
  source 1..3324: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10199 - RNA, 3735 nt, synthetic construct
  misc_feature 1..3735: note = Cas9 variant mRNA product
  source 1..3735: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10200 - RNA, 4293 nt, synthetic construct
  misc_feature 1..4293: note = Cpf1 variant mRNA product
  source 1..4293: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10201 - RNA, 4272 nt, synthetic construct
  misc_feature 1..4272: note = Cpf1 variant mRNA product
  source 1..4272: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10202 - RNA, 4476 nt, synthetic construct
  misc_feature 1..4476: note = Cas9 variant mRNA product
  source 1..4476: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10203 - RNA, 5259 nt, synthetic construct
  misc_feature 1..5259: note = Cas9 variant mRNA product
  source 1..5259: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10204 - RNA, 3531 nt, synthetic construct
  misc_feature 1..3531: note = Cas9 variant mRNA product
  source 1..3531: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10205 - RNA, 4599 nt, synthetic construct
  misc_feature 1..4599: note = Cas9 variant mRNA product
  source 1..4599: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10206 - RNA, 3675 nt, synthetic construct
  misc_feature 1..3675: note = Cas9 variant mRNA product
  source 1..3675: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10207 - RNA, 4536 nt, synthetic construct
  misc_feature 1..4536: note = Cas9 variant mRNA product
  source 1..4536: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10208 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10209 - RNA, 4374 nt, synthetic construct
  misc_feature 1..4374: note = Cas9 variant mRNA product
  source 1..4374: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10210 - RNA, 4407 nt, synthetic construct
  misc_feature 1..4407: note = Cas9 variant mRNA product
  source 1..4407: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10211 - RNA, 3540 nt, synthetic construct
  misc_feature 1..3540: note = Cas9 variant mRNA product
  source 1..3540: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10212 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10213 - RNA, 3624 nt, synthetic construct
  misc_feature 1..3624: note = Cas9 variant mRNA product
  source 1..3624: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10214 - RNA, 3324 nt, synthetic construct
  misc_feature 1..3324: note = Cas9 variant mRNA product
  source 1..3324: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10215 - RNA, 3735 nt, synthetic construct
  misc_feature 1..3735: note = Cas9 variant mRNA product
  source 1..3735: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10216 - RNA, 4293 nt, synthetic construct
  misc_feature 1..4293: note = Cpf1 variant mRNA product
  source 1..4293: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10217 - RNA, 4272 nt, synthetic construct
  misc_feature 1..4272: note = Cpf1 variant mRNA product
  source 1..4272: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10218 - RNA, 4476 nt, synthetic construct
  misc_feature 1..4476: note = Cas9 variant mRNA product
  source 1..4476: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10219 - RNA, 5259 nt, synthetic construct
  misc_feature 1..5259: note = Cas9 variant mRNA product
  source 1..5259: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10220 - RNA, 3531 nt, synthetic construct
  misc_feature 1..3531: note = Cas9 variant mRNA product
  source 1..3531: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10221 - RNA, 4599 nt, synthetic construct
  misc_feature 1..4599: note = Cas9 variant mRNA product
  source 1..4599: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10222 - RNA, 3675 nt, synthetic construct
  misc_feature 1..3675: note = Cas9 variant mRNA product
  source 1..3675: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10223 - RNA, 4536 nt, synthetic construct
  misc_feature 1..4536: note = Cas9 variant mRNA product
  source 1..4536: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10224 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10225 - RNA, 4374 nt, synthetic construct
  misc_feature 1..4374: note = Cas9 variant mRNA product
  source 1..4374: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10226 - RNA, 4407 nt, synthetic construct
  misc_feature 1..4407: note = Cas9 variant mRNA product
  source 1..4407: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10227 - RNA, 3540 nt, synthetic construct
  misc_feature 1..3540: note = Cas9 variant mRNA product
  source 1..3540: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10228 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10229 - RNA, 3624 nt, synthetic construct
  misc_feature 1..3624: note = Cas9 variant mRNA product
  source 1..3624: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10230 - RNA, 3324 nt, synthetic construct
  misc_feature 1..3324: note = Cas9 variant mRNA product
  source 1..3324: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10231 - RNA, 3735 nt, synthetic construct
  misc_feature 1..3735: note = Cas9 variant mRNA product
  source 1..3735: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10232 - RNA, 4293 nt, synthetic construct
  misc_feature 1..4293: note = Cpf1 variant mRNA product
  source 1..4293: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10233 - RNA, 4272 nt, synthetic construct
  misc_feature 1..4272: note = Cpf1 variant mRNA product
  source 1..4272: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10234 - RNA, 4476 nt, synthetic construct
  misc_feature 1..4476: note = Cas9 variant mRNA product
  source 1..4476: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10235 - RNA, 5259 nt, synthetic construct
  misc_feature 1..5259: note = Cas9 variant mRNA product
  source 1..5259: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10236 - RNA, 3531 nt, synthetic construct
  misc_feature 1..3531: note = Cas9 variant mRNA product
  source 1..3531: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10237 - RNA, 4599 nt, synthetic construct
  misc_feature 1..4599: note = Cas9 variant mRNA product
  source 1..4599: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10238 - RNA, 3675 nt, synthetic construct
  misc_feature 1..3675: note = Cas9 variant mRNA product
  source 1..3675: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10239 - RNA, 4536 nt, synthetic construct
  misc_feature 1..4536: note = Cas9 variant mRNA product
  source 1..4536: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10240 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10241 - RNA, 4374 nt, synthetic construct
  misc_feature 1..4374: note = Cas9 variant mRNA product
  source 1..4374: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10242 - RNA, 4407 nt, synthetic construct
  misc_feature 1..4407: note = Cas9 variant mRNA product
  source 1..4407: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10243 - RNA, 3540 nt, synthetic construct
  misc_feature 1..3540: note = Cas9 variant mRNA product
  source 1..3540: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10244 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10245 - RNA, 3624 nt, synthetic construct
  misc_feature 1..3624: note = Cas9 variant mRNA product
  source 1..3624: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10246 - RNA, 3324 nt, synthetic construct
  misc_feature 1..3324: note = Cas9 variant mRNA product
  source 1..3324: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10247 - RNA, 3735 nt, synthetic construct
  misc_feature 1..3735: note = Cas9 variant mRNA product
  source 1..3735: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10248 - RNA, 4293 nt, synthetic construct
  misc_feature 1..4293: note = Cpf1 variant mRNA product
  source 1..4293: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10249 - RNA, 4272 nt, synthetic construct
  misc_feature 1..4272: note = Cpf1 variant mRNA product
  source 1..4272: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10250 - RNA, 4476 nt, synthetic construct
  misc_feature 1..4476: note = Cas9 variant mRNA product
  source 1..4476: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10251 - RNA, 5259 nt, synthetic construct
  misc_feature 1..5259: note = Cas9 variant mRNA product
  source 1..5259: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10252 - RNA, 3531 nt, synthetic construct
  misc_feature 1..3531: note = Cas9 variant mRNA product
  source 1..3531: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10253 - RNA, 4599 nt, synthetic construct
  misc_feature 1..4599: note = Cas9 variant mRNA product
  source 1..4599: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10254 - RNA, 3675 nt, synthetic construct
  misc_feature 1..3675: note = Cas9 variant mRNA product
  source 1..3675: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10255 - RNA, 4536 nt, synthetic construct
  misc_feature 1..4536: note = Cas9 variant mRNA product
  source 1..4536: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10256 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10257 - RNA, 4374 nt, synthetic construct
  misc_feature 1..4374: note = Cas9 variant mRNA product
  source 1..4374: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10258 - RNA, 4407 nt, synthetic construct
  misc_feature 1..4407: note = Cas9 variant mRNA product
  source 1..4407: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10259 - RNA, 3540 nt, synthetic construct
  misc_feature 1..3540: note = Cas9 variant mRNA product
  source 1..3540: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10260 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10261 - RNA, 3624 nt, synthetic construct
  misc_feature 1..3624: note = Cas9 variant mRNA product
  source 1..3624: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10262 - RNA, 3324 nt, synthetic construct
  misc_feature 1..3324: note = Cas9 variant mRNA product
  source 1..3324: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10263 - RNA, 3735 nt, synthetic construct
  misc_feature 1..3735: note = Cas9 variant mRNA product
  source 1..3735: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10264 - RNA, 4293 nt, synthetic construct
  misc_feature 1..4293: note = Cpf1 variant mRNA product
  source 1..4293: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10265 - RNA, 4272 nt, synthetic construct
  misc_feature 1..4272: note = Cpf1 variant mRNA product
  source 1..4272: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10266 - RNA, 4476 nt, synthetic construct
  misc_feature 1..4476: note = Cas9 variant mRNA product
  source 1..4476: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10267 - RNA, 5259 nt, synthetic construct
  misc_feature 1..5259: note = Cas9 variant mRNA product
  source 1..5259: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10268 - RNA, 3531 nt, synthetic construct
  misc_feature 1..3531: note = Cas9 variant mRNA product
  source 1..3531: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10269 - RNA, 4599 nt, synthetic construct
  misc_feature 1..4599: note = Cas9 variant mRNA product
  source 1..4599: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10270 - RNA, 3675 nt, synthetic construct
  misc_feature 1..3675: note = Cas9 variant mRNA product
  source 1..3675: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10271 - RNA, 4536 nt, synthetic construct
  misc_feature 1..4536: note = Cas9 variant mRNA product
  source 1..4536: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10272 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10273 - RNA, 4374 nt, synthetic construct
  misc_feature 1..4374: note = Cas9 variant mRNA product
  source 1..4374: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10274 - RNA, 4407 nt, synthetic construct
  misc_feature 1..4407: note = Cas9 variant mRNA product
  source 1..4407: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10275 - RNA, 3540 nt, synthetic construct
  misc_feature 1..3540: note = Cas9 variant mRNA product
  source 1..3540: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10276 - RNA, 3618 nt, synthetic construct
  misc_feature 1..3618: note = Cas9 variant mRNA product
  source 1..3618: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10277 - RNA, 3624 nt, synthetic construct
  misc_feature 1..3624: note = Cas9 variant mRNA product
  source 1..3624: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10278 - RNA, 3324 nt, synthetic construct
  misc_feature 1..3324: note = Cas9 variant mRNA product
  source 1..3324: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10279 - RNA, 3735 nt, synthetic construct
  misc_feature 1..3735: note = Cas9 variant mRNA product
  source 1..3735: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10280 - RNA, 4293 nt, synthetic construct
  misc_feature 1..4293: note = Cpf1 variant mRNA product
  source 1..4293: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10281 - RNA, 4272 nt, synthetic construct
  misc_feature 1..4272: note = Cpf1 variant mRNA product
  source 1..4272: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10282 - RNA, 4599 nt, synthetic construct
  misc_feature 1..4599: note = Cas9 variant mRNA product
  source 1..4599: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10283 - RNA, 5382 nt, synthetic construct
  misc_feature 1..5382: note = Cas9 variant mRNA product
  source 1..5382: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10284 - RNA, 3654 nt, synthetic construct
  misc_feature 1..3654: note = Cas9 variant mRNA product
  source 1..3654: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10285 - RNA, 4722 nt, synthetic construct
  misc_feature 1..4722: note = Cas9 variant mRNA product
  source 1..4722: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10286 - RNA, 3798 nt, synthetic construct
  misc_feature 1..3798: note = Cas9 variant mRNA product
  source 1..3798: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10287 - RNA, 4659 nt, synthetic construct
  misc_feature 1..4659: note = Cas9 variant mRNA product
  source 1..4659: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10288 - RNA, 3741 nt, synthetic construct
  misc_feature 1..3741: note = Cas9 variant mRNA product
  source 1..3741: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10289 - RNA, 4497 nt, synthetic construct
  misc_feature 1..4497: note = Cas9 variant mRNA product
  source 1..4497: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10290 - RNA, 4530 nt, synthetic construct
  misc_feature 1..4530: note = Cas9 variant mRNA product
  source 1..4530: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10291 - RNA, 3663 nt, synthetic construct
  misc_feature 1..3663: note = Cas9 variant mRNA product
  source 1..3663: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10292 - RNA, 3741 nt, synthetic construct
  misc_feature 1..3741: note = Cas9 variant mRNA product
  source 1..3741: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10293 - RNA, 3747 nt, synthetic construct
  misc_feature 1..3747: note = Cas9 variant mRNA product
  source 1..3747: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10294 - RNA, 3447 nt, synthetic construct
  misc_feature 1..3447: note = Cas9 variant mRNA product
  source 1..3447: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10295 - RNA, 3858 nt, synthetic construct
  misc_feature 1..3858: note = Cas9 variant mRNA product
  source 1..3858: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10296 - RNA, 4416 nt, synthetic construct
  misc_feature 1..4416: note = Cpf1 variant mRNA product
  source 1..4416: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10297 - RNA, 4395 nt, synthetic construct
  misc_feature 1..4395: note = Cpf1 variant mRNA product
  source 1..4395: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10298 - RNA, 4596 nt, synthetic construct
  misc_feature 1..4596: note = Cas9 variant mRNA product
  source 1..4596: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10299 - RNA, 5379 nt, synthetic construct
  misc_feature 1..5379: note = Cas9 variant mRNA product
  source 1..5379: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10300 - RNA, 3651 nt, synthetic construct
  misc_feature 1..3651: note = Cas9 variant mRNA product
  source 1..3651: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10301 - RNA, 4719 nt, synthetic construct
  misc_feature 1..4719: note = Cas9 variant mRNA product
  source 1..4719: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10302 - RNA, 3795 nt, synthetic construct
  misc_feature 1..3795: note = Cas9 variant mRNA product
  source 1..3795: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10303 - RNA, 4656 nt, synthetic construct
  misc_feature 1..4656: note = Cas9 variant mRNA product
  source 1..4656: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10304 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10305 - RNA, 4494 nt, synthetic construct
  misc_feature 1..4494: note = Cas9 variant mRNA product
  source 1..4494: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10306 - RNA, 4527 nt, synthetic construct
  misc_feature 1..4527: note = Cas9 variant mRNA product
  source 1..4527: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10307 - RNA, 3660 nt, synthetic construct
  misc_feature 1..3660: note = Cas9 variant mRNA product
  source 1..3660: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10308 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10309 - RNA, 3744 nt, synthetic construct
  misc_feature 1..3744: note = Cas9 variant mRNA product
  source 1..3744: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10310 - RNA, 3444 nt, synthetic construct
  misc_feature 1..3444: note = Cas9 variant mRNA product
  source 1..3444: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10311 - RNA, 3855 nt, synthetic construct
  misc_feature 1..3855: note = Cas9 variant mRNA product
  source 1..3855: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10312 - RNA, 4413 nt, synthetic construct
  misc_feature 1..4413: note = Cpf1 variant mRNA product
  source 1..4413: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10313 - RNA, 4392 nt, synthetic construct
  misc_feature 1..4392: note = Cpf1 variant mRNA product
  source 1..4392: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10314 - RNA, 4596 nt, synthetic construct
  misc_feature 1..4596: note = Cas9 variant mRNA product
  source 1..4596: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10315 - RNA, 5379 nt, synthetic construct
  misc_feature 1..5379: note = Cas9 variant mRNA product
  source 1..5379: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10316 - RNA, 3651 nt, synthetic construct
  misc_feature 1..3651: note = Cas9 variant mRNA product
  source 1..3651: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10317 - RNA, 4719 nt, synthetic construct
  misc_feature 1..4719: note = Cas9 variant mRNA product
  source 1..4719: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10318 - RNA, 3795 nt, synthetic construct
  misc_feature 1..3795: note = Cas9 variant mRNA product
  source 1..3795: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10319 - RNA, 4656 nt, synthetic construct
  misc_feature 1..4656: note = Cas9 variant mRNA product
  source 1..4656: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10320 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10321 - RNA, 4494 nt, synthetic construct
  misc_feature 1..4494: note = Cas9 variant mRNA product
  source 1..4494: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10322 - RNA, 4527 nt, synthetic construct
  misc_feature 1..4527: note = Cas9 variant mRNA product
  source 1..4527: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10323 - RNA, 3660 nt, synthetic construct
  misc_feature 1..3660: note = Cas9 variant mRNA product
  source 1..3660: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10324 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10325 - RNA, 3744 nt, synthetic construct
  misc_feature 1..3744: note = Cas9 variant mRNA product
  source 1..3744: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10326 - RNA, 3444 nt, synthetic construct
  misc_feature 1..3444: note = Cas9 variant mRNA product
  source 1..3444: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10327 - RNA, 3855 nt, synthetic construct
  misc_feature 1..3855: note = Cas9 variant mRNA product
  source 1..3855: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10328 - RNA, 4413 nt, synthetic construct
  misc_feature 1..4413: note = Cpf1 variant mRNA product
  source 1..4413: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10329 - RNA, 4392 nt, synthetic construct
  misc_feature 1..4392: note = Cpf1 variant mRNA product
  source 1..4392: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10330 - RNA, 4596 nt, synthetic construct
  misc_feature 1..4596: note = Cas9 variant mRNA product
  source 1..4596: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10331 - RNA, 5379 nt, synthetic construct
  misc_feature 1..5379: note = Cas9 variant mRNA product
  source 1..5379: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10332 - RNA, 3651 nt, synthetic construct
  misc_feature 1..3651: note = Cas9 variant mRNA product
  source 1..3651: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10333 - RNA, 4719 nt, synthetic construct
  misc_feature 1..4719: note = Cas9 variant mRNA product
  source 1..4719: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10334 - RNA, 3795 nt, synthetic construct
  misc_feature 1..3795: note = Cas9 variant mRNA product
  source 1..3795: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10335 - RNA, 4656 nt, synthetic construct
  misc_feature 1..4656: note = Cas9 variant mRNA product
  source 1..4656: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10336 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10337 - RNA, 4494 nt, synthetic construct
  misc_feature 1..4494: note = Cas9 variant mRNA product
  source 1..4494: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10338 - RNA, 4527 nt, synthetic construct
  misc_feature 1..4527: note = Cas9 variant mRNA product
  source 1..4527: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10339 - RNA, 3660 nt, synthetic construct
  misc_feature 1..3660: note = Cas9 variant mRNA product
  source 1..3660: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10340 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10341 - RNA, 3744 nt, synthetic construct
  misc_feature 1..3744: note = Cas9 variant mRNA product
  source 1..3744: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10342 - RNA, 3444 nt, synthetic construct
  misc_feature 1..3444: note = Cas9 variant mRNA product
  source 1..3444: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10343 - RNA, 3855 nt, synthetic construct
  misc_feature 1..3855: note = Cas9 variant mRNA product
  source 1..3855: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10344 - RNA, 4413 nt, synthetic construct
  misc_feature 1..4413: note = Cpf1 variant mRNA product
  source 1..4413: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10345 - RNA, 4392 nt, synthetic construct
  misc_feature 1..4392: note = Cpf1 variant mRNA product
  source 1..4392: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10346 - RNA, 4596 nt, synthetic construct
  misc_feature 1..4596: note = Cas9 variant mRNA product
  source 1..4596: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10347 - RNA, 5379 nt, synthetic construct
  misc_feature 1..5379: note = Cas9 variant mRNA product
  source 1..5379: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10348 - RNA, 3651 nt, synthetic construct
  misc_feature 1..3651: note = Cas9 variant mRNA product
  source 1..3651: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10349 - RNA, 4719 nt, synthetic construct
  misc_feature 1..4719: note = Cas9 variant mRNA product
  source 1..4719: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10350 - RNA, 3795 nt, synthetic construct
  misc_feature 1..3795: note = Cas9 variant mRNA product
  source 1..3795: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10351 - RNA, 4656 nt, synthetic construct
  misc_feature 1..4656: note = Cas9 variant mRNA product
  source 1..4656: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10352 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10353 - RNA, 4494 nt, synthetic construct
  misc_feature 1..4494: note = Cas9 variant mRNA product
  source 1..4494: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10354 - RNA, 4527 nt, synthetic construct
  misc_feature 1..4527: note = Cas9 variant mRNA product
  source 1..4527: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10355 - RNA, 3660 nt, synthetic construct
  misc_feature 1..3660: note = Cas9 variant mRNA product
  source 1..3660: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10356 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10357 - RNA, 3744 nt, synthetic construct
  misc_feature 1..3744: note = Cas9 variant mRNA product
  source 1..3744: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10358 - RNA, 3444 nt, synthetic construct
  misc_feature 1..3444: note = Cas9 variant mRNA product
  source 1..3444: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10359 - RNA, 3855 nt, synthetic construct
  misc_feature 1..3855: note = Cas9 variant mRNA product
  source 1..3855: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10360 - RNA, 4413 nt, synthetic construct
  misc_feature 1..4413: note = Cpf1 variant mRNA product
  source 1..4413: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10361 - RNA, 4392 nt, synthetic construct
  misc_feature 1..4392: note = Cpf1 variant mRNA product
  source 1..4392: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10362 - RNA, 4596 nt, synthetic construct
  misc_feature 1..4596: note = Cas9 variant mRNA product
  source 1..4596: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10363 - RNA, 5379 nt, synthetic construct
  misc_feature 1..5379: note = Cas9 variant mRNA product
  source 1..5379: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10364 - RNA, 3651 nt, synthetic construct
  misc_feature 1..3651: note = Cas9 variant mRNA product
  source 1..3651: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10365 - RNA, 4719 nt, synthetic construct
  misc_feature 1..4719: note = Cas9 variant mRNA product
  source 1..4719: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10366 - RNA, 3795 nt, synthetic construct
  misc_feature 1..3795: note = Cas9 variant mRNA product
  source 1..3795: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10367 - RNA, 4656 nt, synthetic construct
  misc_feature 1..4656: note = Cas9 variant mRNA product
  source 1..4656: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10368 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10369 - RNA, 4494 nt, synthetic construct
  misc_feature 1..4494: note = Cas9 variant mRNA product
  source 1..4494: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10370 - RNA, 4527 nt, synthetic construct
  misc_feature 1..4527: note = Cas9 variant mRNA product
  source 1..4527: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10371 - RNA, 3660 nt, synthetic construct
  misc_feature 1..3660: note = Cas9 variant mRNA product
  source 1..3660: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10372 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10373 - RNA, 3744 nt, synthetic construct
  misc_feature 1..3744: note = Cas9 variant mRNA product
  source 1..3744: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10374 - RNA, 3444 nt, synthetic construct
  misc_feature 1..3444: note = Cas9 variant mRNA product
  source 1..3444: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10375 - RNA, 3855 nt, synthetic construct
  misc_feature 1..3855: note = Cas9 variant mRNA product
  source 1..3855: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10376 - RNA, 4413 nt, synthetic construct
  misc_feature 1..4413: note = Cpf1 variant mRNA product
  source 1..4413: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10377 - RNA, 4392 nt, synthetic construct
  misc_feature 1..4392: note = Cpf1 variant mRNA product
  source 1..4392: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10378 - RNA, 4596 nt, synthetic construct
  misc_feature 1..4596: note = Cas9 variant mRNA product
  source 1..4596: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10379 - RNA, 5379 nt, synthetic construct
  misc_feature 1..5379: note = Cas9 variant mRNA product
  source 1..5379: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10380 - RNA, 3651 nt, synthetic construct
  misc_feature 1..3651: note = Cas9 variant mRNA product
  source 1..3651: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10381 - RNA, 4719 nt, synthetic construct
  misc_feature 1..4719: note = Cas9 variant mRNA product
  source 1..4719: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10382 - RNA, 3795 nt, synthetic construct
  misc_feature 1..3795: note = Cas9 variant mRNA product
  source 1..3795: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10383 - RNA, 4656 nt, synthetic construct
  misc_feature 1..4656: note = Cas9 variant mRNA product
  source 1..4656: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10384 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10385 - RNA, 4494 nt, synthetic construct
  misc_feature 1..4494: note = Cas9 variant mRNA product
  source 1..4494: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10386 - RNA, 4527 nt, synthetic construct
  misc_feature 1..4527: note = Cas9 variant mRNA product
  source 1..4527: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10387 - RNA, 3660 nt, synthetic construct
  misc_feature 1..3660: note = Cas9 variant mRNA product
  source 1..3660: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10388 - RNA, 3738 nt, synthetic construct
  misc_feature 1..3738: note = Cas9 variant mRNA product
  source 1..3738: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10389 - RNA, 3744 nt, synthetic construct
  misc_feature 1..3744: note = Cas9 variant mRNA product
  source 1..3744: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10390 - RNA, 3444 nt, synthetic construct
  misc_feature 1..3444: note = Cas9 variant mRNA product
  source 1..3444: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10391 - RNA, 3855 nt, synthetic construct
  misc_feature 1..3855: note = Cas9 variant mRNA product
  source 1..3855: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10392 - RNA, 4413 nt, synthetic construct
  misc_feature 1..4413: note = Cpf1 variant mRNA product
  source 1..4413: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10393 - RNA, 4392 nt, synthetic construct
  misc_feature 1..4392: note = Cpf1 variant mRNA product
  source 1..4392: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10394 - RNA, 4204 nt, synthetic construct
  misc_feature 1..4204: note = Cpf1 variant mRNA product
  source 1..4204: mol_type = other RNA
ggggcgctgcctacggaggtggcagccatctccttctcggcatcaagcttaccatgagcaagctggagaagtttacaaactgctactccctgtctaagaccctgaggttcaaggccatccctgtgggcaagacccaggagaacatcgacaataagcggctgctggtggaggacgagaagagagccgaggattataagggcgtgaagaagctgctggatcgctactatctgtcttttatcaacgacgtgctgcacagcatcaagctgaagaatctgaacaattacatcagcctgttccggaagaaaaccagaaccgagaaggagaataaggagctggagaacctggagatcaatctgcggaaggagatcgccaaggccttcaagggcaacgagggctacaagtccctgtttaagaaggatatcatcgagacaatcctgccagagttcctggacgataaggacgagatcgccctggtgaacagcttcaatggctttaccacagccttcaccggcttctttgataacagagagaatatgttttccgaggaggccaagagcacatccatcgccttcaggtgtatcaacgagaatctgacccgctacatctctaatatggacatcttcgagaaggtggacgccatctttgataagcacgaggtgcaggagatcaaggagaagatcctgaacagcgactatgatgtggaggatttctttgagggcgagttctttaactttgtgctgacacaggagggcatcgacgtgtataacgccatcatcggcggcttcgtgaccgagagcggcgagaagatcaagggcctgaacgagtacatcaacctgtataatcagaaaaccaagcagaagctgcctaagtttaagccactgtataaacaggtgctgagcgatcgggagtctctgagcttctacggcgagggctatacatccgatgaggaggtgctggaggtgtttagaaacaccctgaacaagaacagcgagatcttcagctccatcaagaagctggagaagctgttcaagaattttgacgagtactctagcgccggcatctttgtgaagaacggccccgccatcagcacaatctccaaggatatcttcggcgagtggaacgtgatccgggacaagtggaatgccgagtatgacgatatccacctgaagaagaaggccgtggtgaccgagaagtacgaggacgatcggagaaagtccttcaagaagatcggctccttttctctggagcagctgcaggagtacgccgacgccgatctgtctgtggtggagaagctgaaggagatcatcatccagaaggtggatgagatctacaaggtgtatggctcctctgagaagctgttcgacgccgattttgtgctggagaagagcctgaagaagaacgacgccgtggtggccatcatgaaggacctgctggattctgtgaagagcttcgagaattacatcaaggccttctttggcgagggcaaggagacaaacagggacgagtccttctatggcgattttgtgctggcctacgacatcctgctgaaggtggaccacatctacgatgccatccgcaattatgtgacccagaagccctactctaaggataagttcaagctgtattttcagaaccctcagttcatgggcggctgggacaaggataaggagacagactatcgggccaccatcctgagatacggctccaagtactatctggccatcatggataagaagtacgccaagtgcctgcagaagatcgacaaggacgatgtgaacggcaattacgagaagatcaactataagctgctgcccggccctaataagatgctgccaaaggtgttcttttctaagaagtggatggcctactataaccccagcgaggacatccagaagatctacaagaatggcacattcaagaagggcgatatgtttaacctgaatgactgtcacaagctgatcgacttctttaaggatagcatctcccggtatccaaagtggtccaatgcctacgatttcaacttttctgagacagagaagtataaggacatcgccggcttttacagagaggtggaggagcagggctataaggtgagcttcgagtctgccagcaagaaggaggtggataagctggtggaggagggcaagctgtatatgttccagatctataacaaggacttttccgataagtctcacggcacacccaatctgcacaccatgtacttcaagctgctgtttgacgagaacaatcacggacagatcaggctgagcggaggagcagagctgttcatgaggcgcgcctccctgaagaaggaggagctggtggtgcacccagccaactcccctatcgccaacaagaatccagataatcccaagaaaaccacaaccctgtcctacgacgtgtataaggataagaggttttctgaggaccagtacgagctgcacatcccaatcgccatcaataagtgccccaagaacatcttcaagatcaatacagaggtgcgcgtgctgctgaagcacgacgataacccctatgtgatcggcatcgataggggcgagcgcaatctgctgtatatcgtggtggtggacggcaagggcaacatcgtggagcagtattccctgaacgagatcatcaacaacttcaacggcatcaggatcaagacagattaccactctctgctggacaagaaggagaaggagaggttcgaggcccgccagaactggacctccatcgagaatatcaaggagctgaaggccggctatatctctcaggtggtgcacaagatctgcgagctggtggagaagtacgatgccgtgatcgccctggaggacctgaactctggctttaagaatagccgcgtgaaggtggagaaacaggtgtatcagaagttcgagaagatgctgatcgataagctgaactacatggtggacaagaagtctaatccttgtgcaacaggcggcgccctgaagggctatcagatcaccaataagttcgagagctttaagtccatgtctacccagaacggcttcatcttttacatccctgcctggctgacatccaagatcgatccatctaccggctttgtgaacctgctgaaaaccaagtataccagcatcgccgattccaagaagttcatcagctcctttgacaggatcatgtacgtgcccgaggaggatctgttcgagtttgccctggactataagaacttctctcgcacagacgccgattacatcaagaagtggaagctgtactcctacggcaaccggatcagaatcttccggaatcctaagaagaacaacgtgttcgactgggaggaggtgtgcctgaccagcgcctataaggagctgttcaacaagtacggcatcaattatcagcagggcgatatcagagccctgctgtgcgagcagtccgacaaggccttctactctagctttatggccctgatgagcctgatgctgcagatgcggaacagcatcacaggccgcaccgacgtggattttctgatcagccctgtgaagaactccgacggcatcttctacgatagccggaactatgaggcccaggagaatgccatcctgccaaagaacgccgacgccaatggcgcctataacatcgccagaaaggtgctgtgggccatcggccagttcaagaaggccgaggacgagaagctggataaggtgaagatcgccatctctaacaaggagtggctggagtacgcccagaccagcgtgaagcacaaaaggccggcggccacgaaaaaggccggccaggcaaaaaagaaaaagggatcctacccatacgatgttccagattacgcttatccctacgacgtgcctgattatgcatacccatatgatgtccccgactatgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10395 - RNA, 3786 nt, synthetic construct
  misc_feature 1..3786: note = Cpf1 variant
  source 1..3786: mol_type = other RNA
atggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtga

SEQ ID NO: 10396 - RNA, 3786 nt, synthetic construct
  misc_feature 1..3786: note = Cpf1 variant
  source 1..3786: mol_type = other RNA
atggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtga

SEQ ID NO: 10397 - RNA, 3786 nt, synthetic construct
  misc_feature 1..3786: note = Cpf1 variant
  source 1..3786: mol_type = other RNA
atggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtga

SEQ ID NO: 10398 - RNA, 3786 nt, synthetic construct
  misc_feature 1..3786: note = Cpf1 variant
  source 1..3786: mol_type = other RNA
atggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatga

SEQ ID NO: 10399 - RNA, 3786 nt, synthetic construct
  misc_feature 1..3786: note = Cpf1 variant
  source 1..3786: mol_type = other RNA
atggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtga

SEQ ID NO: 10400 - RNA, 3786 nt, synthetic construct
  misc_feature 1..3786: note = Cpf1 variant
  source 1..3786: mol_type = other RNA
atggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtga

SEQ ID NO: 10401 - RNA, 3786 nt, synthetic construct
  misc_feature 1..3786: note = Cpf1 variant
  source 1..3786: mol_type = other RNA
atggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatga

SEQ ID NO: 10402 - RNA, 4302 nt, synthetic construct
  misc_feature 1..4302: note = Cpf1 variant mRNA product
  source 1..4302: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10403 - RNA, 4302 nt, synthetic construct
  misc_feature 1..4302: note = Cpf1 variant mRNA product
  source 1..4302: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10404 - RNA, 4302 nt, synthetic construct
  misc_feature 1..4302: note = Cpf1 variant mRNA product
  source 1..4302: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10405 - RNA, 4302 nt, synthetic construct
  misc_feature 1..4302: note = Cpf1 variant mRNA product
  source 1..4302: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10406 - RNA, 4302 nt, synthetic construct
  misc_feature 1..4302: note = Cpf1 variant mRNA product
  source 1..4302: mol_type = other RNA
gggagagtcccgcagtcggcgtccagcggctctgcttgttcgtgtgtgtgtcgttgcaggccttattcaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10407 - RNA, 4302 nt, synthetic construct
  misc_feature 1..4302: note = Cpf1 variant mRNA product
  source 1..4302: mol_type = other RNA
gggagagtcccgcagtcggcgtccagcggctctgcttgttcgtgtgtgtgtcgttgcaggccttattcaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10408 - RNA, 4302 nt, synthetic construct
  misc_feature 1..4302: note = Cpf1 variant mRNA product
  source 1..4302: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10409 - RNA, 4399 nt, synthetic construct
  misc_feature 1..4399: note = Cpf1 variant mRNA product
  source 1..4399: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10410 - RNA, 4399 nt, synthetic construct
  misc_feature 1..4399: note = Cpf1 variant mRNA product
  source 1..4399: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10411 - RNA, 4399 nt, synthetic construct
  misc_feature 1..4399: note = Cpf1 variant mRNA product
  source 1..4399: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10412 - RNA, 4399 nt, synthetic construct
  misc_feature 1..4399: note = Cpf1 variant mRNA product
  source 1..4399: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10413 - RNA, 4399 nt, synthetic construct
  misc_feature 1..4399: note = Cpf1 variant mRNA product
  source 1..4399: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10414 - RNA, 4399 nt, synthetic construct
  misc_feature 1..4399: note = Cpf1 variant mRNA product
  source 1..4399: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10415 - RNA, 4399 nt, synthetic construct
  misc_feature 1..4399: note = Cpf1 variant mRNA product
  source 1..4399: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10416 - RNA, 4083 nt, synthetic construct
  misc_feature 1..4083: note = Cpf1 variant mRNA product
  source 1..4083: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10417 - RNA, 4083 nt, synthetic construct
  misc_feature 1..4083: note = Cpf1 variant mRNA product
  source 1..4083: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10418 - RNA, 4083 nt, synthetic construct
  misc_feature 1..4083: note = Cpf1 variant mRNA product
  source 1..4083: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10419 - RNA, 4083 nt, synthetic construct
  misc_feature 1..4083: note = Cpf1 variant mRNA product
  source 1..4083: mol_type = other RNA
gggagagcggctcggccattttgtcccagtcagtccggaggctgcggctgcagaagtaccgcctgcggagtaactgcaaagaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10420 - RNA, 4083 nt, synthetic construct
  misc_feature 1..4083: note = Cpf1 variant mRNA product
  source 1..4083: mol_type = other RNA
gggagagcggctcggccattttgtcccagtcagtccggaggctgcggctgcagaagtaccgcctgcggagtaactgcaaagaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10421 - RNA, 4083 nt, synthetic construct
  misc_feature 1..4083: note = Cpf1 variant mRNA product
  source 1..4083: mol_type = other RNA
gggagagcggctcggccattttgtcccagtcagtccggaggctgcggctgcagaagtaccgcctgcggagtaactgcaaagaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10422 - RNA, 4083 nt, synthetic construct
  misc_feature 1..4083: note = Cpf1 variant mRNA product
  source 1..4083: mol_type = other RNA
gggagagcggctcggccattttgtcccagtcagtccggaggctgcggctgcagaagtaccgcctgcggagtaactgcaaagaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10423 - RNA, 4025 nt, synthetic construct
  misc_feature 1..4025: note = Cpf1 variant mRNA product
  source 1..4025: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10424 - RNA, 4025 nt, synthetic construct
  misc_feature 1..4025: note = Cpf1 variant mRNA product
  source 1..4025: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10425 - RNA, 4025 nt, synthetic construct
  misc_feature 1..4025: note = Cpf1 variant mRNA product
  source 1..4025: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10426 - RNA, 4025 nt, synthetic construct
  misc_feature 1..4025: note = Cpf1 variant mRNA product
  source 1..4025: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10427 - RNA, 4025 nt, synthetic construct
  misc_feature 1..4025: note = Cpf1 variant mRNA product
  source 1..4025: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10428 - RNA, 4025 nt, synthetic construct
  misc_feature 1..4025: note = Cpf1 variant mRNA product
  source 1..4025: mol_type = other RNA
gggagagtccgctcagccaggttgcagaagcggcttagcgtgtgtcctaatcttctctctgcgtgtaggtaggcctgtgccgcaaacaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10429 - RNA, 4025 nt, synthetic construct
  misc_feature 1..4025: note = Cpf1 variant mRNA product
  source 1..4025: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10430 - RNA, 4006 nt, synthetic construct
  misc_feature 1..4006: note = Cpf1 variant mRNA product
  source 1..4006: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10431 - RNA, 4006 nt, synthetic construct
  misc_feature 1..4006: note = Cpf1 variant mRNA product
  source 1..4006: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10432 - RNA, 4006 nt, synthetic construct
  misc_feature 1..4006: note = Cpf1 variant mRNA product
  source 1..4006: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10433 - RNA, 4006 nt, synthetic construct
  misc_feature 1..4006: note = Cpf1 variant mRNA product
  source 1..4006: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10434 - RNA, 4006 nt, synthetic construct
  misc_feature 1..4006: note = Cpf1 variant mRNA product
  source 1..4006: mol_type = other RNA
gggagagtcccgcagtcggcgtccagcggctctgcttgttcgtgtgtgtgtcgttgcaggccttattcaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10435 - RNA, 4006 nt, synthetic construct
  misc_feature 1..4006: note = Cpf1 variant mRNA product
  source 1..4006: mol_type = other RNA
gggagagtcccgcagtcggcgtccagcggctctgcttgttcgtgtgtgtgtcgttgcaggccttattcaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10436 - RNA, 4006 nt, synthetic construct
  misc_feature 1..4006: note = Cpf1 variant mRNA product
  source 1..4006: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10437 - RNA, 4116 nt, synthetic construct
  misc_feature 1..4116: note = Cpf1 variant mRNA product
  source 1..4116: mol_type = other RNA
gggagaggcgctgcctacggaggtggcagccatctccttctcggcatcaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10438 - RNA, 4116 nt, synthetic construct
  misc_feature 1..4116: note = Cpf1 variant mRNA product
  source 1..4116: mol_type = other RNA
gggagaggcgctgcctacggaggtggcagccatctccttctcggcatcaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10439 - RNA, 4116 nt, synthetic construct
  misc_feature 1..4116: note = Cpf1 variant mRNA product
  source 1..4116: mol_type = other RNA
gggagaggcgctgcctacggaggtggcagccatctccttctcggcatcaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10440 - RNA, 4116 nt, synthetic construct
  misc_feature 1..4116: note = Cpf1 variant mRNA product
  source 1..4116: mol_type = other RNA
gggagaggcgctgcctacggaggtggcagccatctccttctcggcatcaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10441 - RNA, 4116 nt, synthetic construct
  misc_feature 1..4116: note = Cpf1 variant mRNA product
  source 1..4116: mol_type = other RNA
gggagaggcgctgcctacggaggtggcagccatctccttctcggcatcaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10442 - RNA, 4116 nt, synthetic construct
  misc_feature 1..4116: note = Cpf1 variant mRNA product
  source 1..4116: mol_type = other RNA
gggagaggcgctgcctacggaggtggcagccatctccttctcggcatcaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10443 - RNA, 4116 nt, synthetic construct
  misc_feature 1..4116: note = Cpf1 variant mRNA product
  source 1..4116: mol_type = other RNA
gggagaggcgctgcctacggaggtggcagccatctccttctcggcatcaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10444 - RNA, 4168 nt, synthetic construct
  misc_feature 1..4168: note = Cpf1 variant mRNA product
  source 1..4168: mol_type = other RNA
ggggcgctgcctacggaggtggcagccatctccttctcggcatcaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10445 - RNA, 4168 nt, synthetic construct
  misc_feature 1..4168: note = Cpf1 variant mRNA product
  source 1..4168: mol_type = other RNA
ggggcgctgcctacggaggtggcagccatctccttctcggcatcaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10446 - RNA, 4168 nt, synthetic construct
  misc_feature 1..4168: note = Cpf1 variant mRNA product
  source 1..4168: mol_type = other RNA
ggggcgctgcctacggaggtggcagccatctccttctcggcatcaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10447 - RNA, 4168 nt, synthetic construct
  misc_feature 1..4168: note = Cpf1 variant mRNA product
  source 1..4168: mol_type = other RNA
ggggcgctgcctacggaggtggcagccatctccttctcggcatcaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10448 - RNA, 4168 nt, synthetic construct
  misc_feature 1..4168: note = Cpf1 variant mRNA product
  source 1..4168: mol_type = other RNA
ggggcgctgcctacggaggtggcagccatctccttctcggcatcaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10449 - RNA, 4168 nt, synthetic construct
  misc_feature 1..4168: note = Cpf1 variant mRNA product
  source 1..4168: mol_type = other RNA
ggggcgctgcctacggaggtggcagccatctccttctcggcatcaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10450 - RNA, 4168 nt, synthetic construct
  misc_feature 1..4168: note = Cpf1 variant mRNA product
  source 1..4168: mol_type = other RNA
ggggcgctgcctacggaggtggcagccatctccttctcggcatcaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10451 - RNA, 4070 nt, synthetic construct
  misc_feature 1..4070: note = Cpf1 variant mRNA product
  source 1..4070: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10452 - RNA, 4070 nt, synthetic construct
  misc_feature 1..4070: note = Cpf1 variant mRNA product
  source 1..4070: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10453 - RNA, 4070 nt, synthetic construct
  misc_feature 1..4070: note = Cpf1 variant mRNA product
  source 1..4070: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10454 - RNA, 4070 nt, synthetic construct
  misc_feature 1..4070: note = Cpf1 variant mRNA product
  source 1..4070: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10455 - RNA, 4070 nt, synthetic construct
  misc_feature 1..4070: note = Cpf1 variant mRNA product
  source 1..4070: mol_type = other RNA
gggagagtcccgcagtcggcgtccagcggctctgcttgttcgtgtgtgtgtcgttgcaggccttattcaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10456 - RNA, 4070 nt, synthetic construct
  misc_feature 1..4070: note = Cpf1 variant mRNA product
  source 1..4070: mol_type = other RNA
gggagagtcccgcagtcggcgtccagcggctctgcttgttcgtgtgtgtgtcgttgcaggccttattcaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10457 - RNA, 4070 nt, synthetic construct
  misc_feature 1..4070: note = Cpf1 variant mRNA product
  source 1..4070: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10458 - RNA, 4167 nt, synthetic construct
  misc_feature 1..4167: note = Cpf1 variant mRNA product
  source 1..4167: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10459 - RNA, 4167 nt, synthetic construct
  misc_feature 1..4167: note = Cpf1 variant mRNA product
  source 1..4167: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10460 - RNA, 4167 nt, synthetic construct
  misc_feature 1..4167: note = Cpf1 variant mRNA product
  source 1..4167: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10461 - RNA, 4167 nt, synthetic construct
  misc_feature 1..4167: note = Cpf1 variant mRNA product
  source 1..4167: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10462 - RNA, 4167 nt, synthetic construct
  misc_feature 1..4167: note = Cpf1 variant mRNA product
  source 1..4167: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10463 - RNA, 4167 nt, synthetic construct
  misc_feature 1..4167: note = Cpf1 variant mRNA product
  source 1..4167: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10464 - RNA, 4167 nt, synthetic construct
  misc_feature 1..4167: note = Cpf1 variant mRNA product
  source 1..4167: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10465 - RNA, 4103 nt, synthetic construct
  misc_feature 1..4103: note = Cpf1 variant mRNA product
  source 1..4103: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10466 - RNA, 4103 nt, synthetic construct
  misc_feature 1..4103: note = Cpf1 variant mRNA product
  source 1..4103: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10467 - RNA, 4103 nt, synthetic construct
  misc_feature 1..4103: note = Cpf1 variant mRNA product
  source 1..4103: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10468 - RNA, 4103 nt, synthetic construct
  misc_feature 1..4103: note = Cpf1 variant mRNA product
  source 1..4103: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10469 - RNA, 4103 nt, synthetic construct
  misc_feature 1..4103: note = Cpf1 variant mRNA product
  source 1..4103: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10470 - RNA, 4103 nt, synthetic construct
  misc_feature 1..4103: note = Cpf1 variant mRNA product
  source 1..4103: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10471 - RNA, 4103 nt, synthetic construct
  misc_feature 1..4103: note = Cpf1 variant mRNA product
  source 1..4103: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10472 - RNA, 4052 nt, synthetic construct
  misc_feature 1..4052: note = Cpf1 variant mRNA product
  source 1..4052: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10473 - RNA, 4052 nt, synthetic construct
  misc_feature 1..4052: note = Cpf1 variant mRNA product
  source 1..4052: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10474 - RNA, 4052 nt, synthetic construct
  misc_feature 1..4052: note = Cpf1 variant mRNA product
  source 1..4052: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10475 - RNA, 4052 nt, synthetic construct
  misc_feature 1..4052: note = Cpf1 variant mRNA product
  source 1..4052: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10476 - RNA, 4052 nt, synthetic construct
  misc_feature 1..4052: note = Cpf1 variant mRNA product
  source 1..4052: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10477 - RNA, 4052 nt, synthetic construct
  misc_feature 1..4052: note = Cpf1 variant mRNA product
  source 1..4052: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10478 - RNA, 4052 nt, synthetic construct
  misc_feature 1..4052: note = Cpf1 variant mRNA product
  source 1..4052: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10479 - RNA, 4038 nt, synthetic construct
  misc_feature 1..4038: note = Cpf1 variant mRNA product
  source 1..4038: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10480 - RNA, 4038 nt, synthetic construct
  misc_feature 1..4038: note = Cpf1 variant mRNA product
  source 1..4038: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10481 - RNA, 4038 nt, synthetic construct
  misc_feature 1..4038: note = Cpf1 variant mRNA product
  source 1..4038: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10482 - RNA, 4038 nt, synthetic construct
  misc_feature 1..4038: note = Cpf1 variant mRNA product
  source 1..4038: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10483 - RNA, 4038 nt, synthetic construct
  misc_feature 1..4038: note = Cpf1 variant mRNA product
  source 1..4038: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10484 - RNA, 4038 nt, synthetic construct
  misc_feature 1..4038: note = Cpf1 variant mRNA product
  source 1..4038: mol_type = other RNA
gggagagtccgctcagccaggttgcagaagcggcttagcgtgtgtcctaatcttctctctgcgtgtaggtaggcctgtgccgcaaacaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10485 - RNA, 4038 nt, synthetic construct
  misc_feature 1..4038: note = Cpf1 variant mRNA product
  source 1..4038: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10486 - RNA, 4019 nt, synthetic construct
  misc_feature 1..4019: note = Cpf1 variant mRNA product
  source 1..4019: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10487 - RNA, 4019 nt, synthetic construct
  misc_feature 1..4019: note = Cpf1 variant mRNA product
  source 1..4019: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10488 - RNA, 4019 nt, synthetic construct
  misc_feature 1..4019: note = Cpf1 variant mRNA product
  source 1..4019: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10489 - RNA, 4019 nt, synthetic construct
  misc_feature 1..4019: note = Cpf1 variant mRNA product
  source 1..4019: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10490 - RNA, 4019 nt, synthetic construct
  misc_feature 1..4019: note = Cpf1 variant mRNA product
  source 1..4019: mol_type = other RNA
gggagagtcccgcagtcggcgtccagcggctctgcttgttcgtgtgtgtgtcgttgcaggccttattcaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10491 - RNA, 4019 nt, synthetic construct
  misc_feature 1..4019: note = Cpf1 variant mRNA product
  source 1..4019: mol_type = other RNA
gggagagtcccgcagtcggcgtccagcggctctgcttgttcgtgtgtgtgtcgttgcaggccttattcaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10492 - RNA, 4019 nt, synthetic construct
  misc_feature 1..4019: note = Cpf1 variant mRNA product
  source 1..4019: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10493 - RNA, 4315 nt, synthetic construct
  misc_feature 1..4315: note = Cpf1 variant mRNA product
  source 1..4315: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10494 - RNA, 4315 nt, synthetic construct
  misc_feature 1..4315: note = Cpf1 variant mRNA product
  source 1..4315: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10495 - RNA, 4315 nt, synthetic construct
  misc_feature 1..4315: note = Cpf1 variant mRNA product
  source 1..4315: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10496 - RNA, 4315 nt, synthetic construct
  misc_feature 1..4315: note = Cpf1 variant mRNA product
  source 1..4315: mol_type = other RNA
gggagagcggctcggccattttgtcccagtcagtccggaggctgcggctgcagaagtaccgcctgcggagtaactgcaaagaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10497 - RNA, 4315 nt, synthetic construct
  misc_feature 1..4315: note = Cpf1 variant mRNA product
  source 1..4315: mol_type = other RNA
gggagagcggctcggccattttgtcccagtcagtccggaggctgcggctgcagaagtaccgcctgcggagtaactgcaaagaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10498 - RNA, 4315 nt, synthetic construct
  misc_feature 1..4315: note = Cpf1 variant mRNA product
  source 1..4315: mol_type = other RNA
gggagagcggctcggccattttgtcccagtcagtccggaggctgcggctgcagaagtaccgcctgcggagtaactgcaaagaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10499 - RNA, 4315 nt, synthetic construct
  misc_feature 1..4315: note = Cpf1 variant mRNA product
  source 1..4315: mol_type = other RNA
gggagagcggctcggccattttgtcccagtcagtccggaggctgcggctgcagaagtaccgcctgcggagtaactgcaaagaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10500 - RNA, 4105 nt, synthetic construct
  misc_feature 1..4105: note = Cpf1 variant mRNA product
  source 1..4105: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10501 - RNA, 4105 nt, synthetic construct
  misc_feature 1..4105: note = Cpf1 variant mRNA product
  source 1..4105: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10502 - RNA, 4105 nt, synthetic construct
  misc_feature 1..4105: note = Cpf1 variant mRNA product
  source 1..4105: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10503 - RNA, 4105 nt, synthetic construct
  misc_feature 1..4105: note = Cpf1 variant mRNA product
  source 1..4105: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10504 - RNA, 4105 nt, synthetic construct
  misc_feature 1..4105: note = Cpf1 variant mRNA product
  source 1..4105: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10505 - RNA, 4105 nt, synthetic construct
  misc_feature 1..4105: note = Cpf1 variant mRNA product
  source 1..4105: mol_type = other RNA
gggagagtccgctcagccaggttgcagaagcggcttagcgtgtgtcctaatcttctctctgcgtgtaggtaggcctgtgccgcaaacaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10506 - RNA, 4105 nt, synthetic construct
  misc_feature 1..4105: note = Cpf1 variant mRNA product
  source 1..4105: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10507 - RNA, 4321 nt, synthetic construct
  misc_feature 1..4321: note = Cpf1 variant mRNA product
  source 1..4321: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10508 - RNA, 4321 nt, synthetic construct
  misc_feature 1..4321: note = Cpf1 variant mRNA product
  source 1..4321: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10509 - RNA, 4321 nt, synthetic construct
  misc_feature 1..4321: note = Cpf1 variant mRNA product
  source 1..4321: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10510 - RNA, 4321 nt, synthetic construct
  misc_feature 1..4321: note = Cpf1 variant mRNA product
  source 1..4321: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10511 - RNA, 4321 nt, synthetic construct
  misc_feature 1..4321: note = Cpf1 variant mRNA product
  source 1..4321: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10512 - RNA, 4321 nt, synthetic construct
  misc_feature 1..4321: note = Cpf1 variant mRNA product
  source 1..4321: mol_type = other RNA
gggagagtccgctcagccaggttgcagaagcggcttagcgtgtgtcctaatcttctctctgcgtgtaggtaggcctgtgccgcaaacaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10513 - RNA, 4101 nt, synthetic construct
  misc_feature 1..4101: note = Cpf1 variant mRNA product
  source 1..4101: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10514 - RNA, 4101 nt, synthetic construct; identical to SEQ ID NO: 10513
  misc_feature 1..4101: note = Cpf1 variant mRNA product
  source 1..4101: mol_type = other RNA

SEQ ID NO: 10515 - RNA, 4101 nt, synthetic construct
  misc_feature 1..4101: note = Cpf1 variant mRNA product
  source 1..4101: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10516 - RNA, 4101 nt, synthetic construct
  misc_feature 1..4101: note = Cpf1 variant mRNA product
  source 1..4101: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10517 - RNA, 4101 nt, synthetic construct
  misc_feature 1..4101: note = Cpf1 variant mRNA product
  source 1..4101: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10518 - RNA, 4101 nt, synthetic construct
  misc_feature 1..4101: note = Cpf1 variant mRNA product
  source 1..4101: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10519 - RNA, 4101 nt, synthetic construct
  misc_feature 1..4101: note = Cpf1 variant mRNA product
  source 1..4101: mol_type = other RNA
gggagagtccgctcagccaggttgcagaagcggcttagcgtgtgtcctaatcttctctctgcgtgtaggtaggcctgtgccgcaaacaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10520 - RNA, 4101 nt, synthetic construct
  misc_feature 1..4101: note = Cpf1 variant mRNA product
  source 1..4101: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10521 - RNA, 4128 nt, synthetic construct
  misc_feature 1..4128: note = Cpf1 variant mRNA product
  source 1..4128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10522 - RNA, 4128 nt, synthetic construct
  misc_feature 1..4128: note = Cpf1 variant mRNA product
  source 1..4128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10523 - RNA, 4128 nt, synthetic construct
  misc_feature 1..4128: note = Cpf1 variant mRNA product
  source 1..4128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10524 - RNA, 4128 nt, synthetic construct
  misc_feature 1..4128: note = Cpf1 variant mRNA product
  source 1..4128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10525 - RNA, 4128 nt, synthetic construct
  misc_feature 1..4128: note = Cpf1 variant mRNA product
  source 1..4128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10526 - RNA, 4128 nt, synthetic construct
  misc_feature 1..4128: note = Cpf1 variant mRNA product
  source 1..4128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10527 - RNA, 4128 nt, synthetic construct
  misc_feature 1..4128: note = Cpf1 variant mRNA product
  source 1..4128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10528 - RNA, 4324 nt, synthetic construct
  misc_feature 1..4324: note = Cpf1 variant mRNA product
  source 1..4324: mol_type = other RNA
gggagacccgtgacccggaagttgtacggctacgcgactttccctcccacaaaccctcgcgcccttcctttcctacttgggcccggcagaaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10529 - RNA, 4324 nt, synthetic construct
  misc_feature 1..4324: note = Cpf1 variant mRNA product
  source 1..4324: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10530 - RNA, 4324 nt, synthetic construct
  misc_feature 1..4324: note = Cpf1 variant mRNA product
  source 1..4324: mol_type = other RNA
gggagacccgtgacccggaagttgtacggctacgcgactttccctcccacaaaccctcgcgcccttcctttcctacttgggcccggcagaaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10531 - RNA, 4324 nt, synthetic construct
  misc_feature 1..4324: note = Cpf1 variant mRNA product
  source 1..4324: mol_type = other RNA
gggagacccgtgacccggaagttgtacggctacgcgactttccctcccacaaaccctcgcgcccttcctttcctacttgggcccggcagaaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10532 - RNA, 4324 nt, synthetic construct
  misc_feature 1..4324: note = Cpf1 variant mRNA product
  source 1..4324: mol_type = other RNA
gggagacccgtgacccggaagttgtacggctacgcgactttccctcccacaaaccctcgcgcccttcctttcctacttgggcccggcagaaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10533 - RNA, 4324 nt, synthetic construct
  misc_feature 1..4324: note = Cpf1 variant mRNA product
  source 1..4324: mol_type = other RNA
gggagacccgtgacccggaagttgtacggctacgcgactttccctcccacaaaccctcgcgcccttcctttcctacttgggcccggcagaaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10534 - RNA, 4324 nt, synthetic construct
  misc_feature 1..4324: note = Cpf1 variant mRNA product
  source 1..4324: mol_type = other RNA
gggagacccgtgacccggaagttgtacggctacgcgactttccctcccacaaaccctcgcgcccttcctttcctacttgggcccggcagaaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10535 - RNA, 4059 nt, synthetic construct
  misc_feature 1..4059: note = Cpf1 variant mRNA product
  source 1..4059: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10536 - RNA, 4059 nt, synthetic construct
  misc_feature 1..4059: note = Cpf1 variant mRNA product
  source 1..4059: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10537 - RNA, 4059 nt, synthetic construct
  misc_feature 1..4059: note = Cpf1 variant mRNA product
  source 1..4059: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10538 - RNA, 4059 nt, synthetic construct
  misc_feature 1..4059: note = Cpf1 variant mRNA product
  source 1..4059: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10539 - RNA, 4059 nt, synthetic construct
  misc_feature 1..4059: note = Cpf1 variant mRNA product
  source 1..4059: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10540 - RNA, 4059 nt, synthetic construct
  misc_feature 1..4059: note = Cpf1 variant mRNA product
  source 1..4059: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10541 - RNA, 4059 nt, synthetic construct
  misc_feature 1..4059: note = Cpf1 variant mRNA product
  source 1..4059: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10542 - RNA, 4179 nt, synthetic construct
  misc_feature 1..4179: note = Cpf1 variant mRNA product
  source 1..4179: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaagaagcgcaaggtgggcatccacggggtcccggccgcggccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaagcgccccgccgccaccaagaaggcgggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10543 - RNA, 4179 nt, synthetic construct
  misc_feature 1..4179: note = Cpf1 variant mRNA product
  source 1..4179: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgcagccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagaagagacccgccgctaccaaaaaggcaggccaggccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10544 - RNA, 4179 nt, synthetic construct
  misc_feature 1..4179: note = Cpf1 variant mRNA product
  source 1..4179: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcccccaagaaaaagagaaaagtgggcatccacggggtccctgctgccgccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagaagagacccgccgctaccaaaaaggccggccaggcgaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10545 - RNA, 4179 nt, synthetic construct
  misc_feature 1..4179: note = Cpf1 variant mRNA product
  source 1..4179: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccaaaaaaaaaaagaaaagtaggaatacacggagtaccagcagcagccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaaaaaagaccagcagcaacaaaaaaagcaggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10546 - RNA, 4179 nt, synthetic construct
  misc_feature 1..4179: note = Cpf1 variant mRNA product
  source 1..4179: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcgccgaaaaagaaaaggaaagtgggaatacacggggtgccggcggcggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagaaaaggccagcggcaacaaaaaaggccgggcaagcgaaaaaaaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10547 - RNA, 4179 nt, synthetic construct
  misc_feature 1..4179: note = Cpf1 variant mRNA product
  source 1..4179: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcgcccaaaaaaaaacgcaaagtcggaatccacggcgtgcccgcggccgccgccagcaagctggagaagttcaccaactgctactccctcagcaagaccctgcgcttcaaggcgatccccgtgggcaagacgcaggagaacatcgacaacaagcggctgctcgtcgaggacgagaagcgcgccgaggactacaagggggtgaagaagctgctggaccggtactacctctccttcatcaacgacgtgctgcacagcatcaagctgaagaacctcaacaactacatctccctgttccgcaagaagacccggaccgagaaggagaacaaggagctggagaacctcgagatcaacctgcgcaaggagatcgccaaggccttcaagggcgccgcggggtacaagagcctgttcaagaaggacatcatcgagaccatcctcccggaggccgccgacgacaaggacgagatcgccctggtcaactccttcaacggcttcacgaccgcgttcaccgggttcttcgacaaccgggagaacatgttcagcgaggaggccaagtccaccagcatcgccttccgctgcatcaacgagaacctgacgcggtacatctccaacatggacatcttcgagaaggtggacgccatcttcgacaagcacgaggtgcaggagatcaaggagaagatcctcaacagcgactacgacgtcgaggacttcttcgagggcgagttcttcaacttcgtgctgacccaggagggcatcgacgtgtacaacgccatcatcgggggcttcgtcaccgagtccggggagaagatcaagggcctgaacgagtacatcaacctctacaacgcgaagaccaagcaggccctgcccaagttcaagcccctgtacaagcaggtcctcagcgaccgcgagtccctgagcttctacggggagggctacacgtccgacgaggaggtgctggaggtgttccggaacaccctcaacaagaacagcgagatcttctccagcatcaagaagctggagaagctgttcaagaacttcgacgagtacagctccgccggcatcttcgtgaagaacgggcccgccatcagcaccatctccaaggacatcttcggcgagtggaacctcatccgcgacaagtggaacgccgagtacgacgacatccacctgaagaagaaggcggtggtcaccgagaagtacgaggacgaccggcgcaagagcttcaagaagatcgggtccttcagcctggagcagctccaggagtacgccgacgccgacctgtccgtggtggagaagctgaaggagatcatcatccagaaggtcgacgagatctacaaggtgtacggcagctccgagaagctgttcgacgccgacttcgtgctcgagaagtccctgaagaagaacgacgccgtcgtggcgatcatgaaggacctcctggacagcgtcaagagcttcgagaactacatcaaggccttcttcggcgaggggaaggagacgaaccgggacgagtccttctacggcgacttcgtgctggcctacgacatcctcctgaaggtggaccacatctacgacgccatccgcaactacgtcacccagaagccgtacagcaaggacaagttcaagctgtacttccagaacccccagttcatgggcgggtgggacaaggacaaggagaccgactaccgggccaccatcctccgctacgggtccaagtactacctggcgatcatggacaagaagtacgccaagtgcctgcagaagatcgacaaggacgacgtgaacggcaactacgagaagatcaactacaagctcctgcccggccccaacaagatgctgccgaaggtgttcttcagcaagaagtggatggcctactacaacccctccgaggacatccagaagatctacaagaacgggacgttcaagaagggcgacatgttcaacctgaacgactgccacaagctcatcgacttcttcaaggacagcatctcccggtaccccaagtggagcaacgcctacgacttcaacttcagcgagaccgagaagtacaaggacatcgcggggttctaccgcgaggtcgaggagcagggctacaaggtgtccttcgagagcgcctccaagaaggaggtggacaagctggtcgaggaggggaagctgtacatgttccagatctacaacaaggacttcagcgacaagtcccacggcacccccaacctccacaccatgtacttcaagctgctgttcgacgagaacaaccacggccagatccggctcagcgggggcgccgagctgttcatgcgccgcgcctccctgaagaaggaggagctcgtggtgcacccggccaacagccccatcgcgaacaagaaccccgacaaccccaagaagacgaccaccctgtcctacgacgtctacaaggacaagcggttcagcgaggaccagtacgagctgcacatcccgatcgccatcaacaagtgccccaagaacatcttcaagatcaacaccgaggtgcgcgtgctcctgaagcacgacgacaacccctacgtcatcgggatcgaccggggcgagcgcaacctgctctacatcgtggtggtcgacgggaagggcaacatcgtggagcagtactccctgaacgagatcatcaacaacttcaacggcatccggatcaagacggactaccacagcctgctcgacaagaaggagaaggagcgcttcgaggcccggcagaactggacctccatcgagaacatcaaggagctgaaggccgggtacatcagccaggtggtccacaagatctgcgagctggtggagaagtacgacgccgtgatcgcgctcgaggacctgaactccggcttcaagaacagccgcgtcaaggtggagaagcaggtctaccagaagttcgagaagatgctgatcgacaagctcaactacatggtggacaagaagtccaacccctgcgccaccgggggcgccctgaagggctaccagatcaccaacaagttcgagagcttcaagagcatgtccacgcagaacgggttcatcttctacatcccggcctggctgaccagcaagatcgacccctccaccggcttcgtgaacctcctgaagaccaagtacacgagcatcgccgactccaagaagttcatcagctccttcgaccggatcatgtacgtgcccgaggaggacctgttcgagttcgcgctcgactacaagaacttcagccgcaccgacgccgactacatcaagaagtggaagctgtactcctacgggaaccggatccgcatcttcgccgccgcgaagaagaacaacgtcttcgcctgggaggaggtgtgcctgaccagcgcctacaaggagctgttcaacaagtacggcatcaactaccagcagggggacatccgggccctcctgtgcgagcagtccgacaaggccttctacagctccttcatggcgctcatgagcctgatgctgcagatgcgcaactccatcaccggccggaccgacgtggacttcctcatcagccccgtcaagaactccgacggcatcttctacgacagccgcaactacgaggcccaggagaacgccatcctgccgaagaacgccgacgccaacggggcgtacaacatcgcccggaaggtgctgtgggccatcggccagttcaagaaggccgaggacgagaagctcgacaaggtgaagatcgccatctccaacaaggagtggctggagtacgcgcagacgagcgtcaagaaaaggccggcggcaacaaaaaaggcagggcaggcgaaaaaaaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10548 - RNA, 4179 nt, synthetic construct
  misc_feature 1..4179: note = Cpf1 variant mRNA product
  source 1..4179: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcaccaaaaaaaaaaagaaaagtaggaatacacggagtaccagcagcagccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagaaaagaccagcagcaacaaaaaaagcaggacaagcaaaaaaaaaaaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10549 - RNA, 4441 nt, synthetic construct
  misc_feature 1..4441: note = Cpf1 variant mRNA product
  source 1..4441: mol_type = other RNA
ggggcgctgcctacggaggtggcagccatctccttctcggcatcaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagggatcctacccatacgatgttccagattacgcttatccctacgacgtgcctgattatgcatacccatatgatgtccccgactatgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10550 - RNA, 4204 nt, synthetic construct; identical to SEQ ID NO: 10394
  misc_feature 1..4204: note = Cpf1 variant mRNA product
  source 1..4204: mol_type = other RNA

SEQ ID NO: 10551 - RNA, 48 nt, synthetic construct
  misc_feature 1..48: note = NLS3 variant
  source 1..48: mol_type = other RNA
aaaaggccggcggccacgaaaaaggccggccaggcaaaaaagaaaaag

SEQ ID NO: 10552 - RNA, 3924 nt, synthetic construct
  misc_feature 1..3924: note = Cpf1 variant
  source 1..3924: mol_type = other RNA
atgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaactga

SEQ ID NO: 10553 - RNA, 3972 nt, synthetic construct
  misc_feature 1..3972: note = Cpf1 variant
  source 1..3972: mol_type = other RNA
atgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtga

SEQ ID NO: 10554 - RNA, 4488 nt, synthetic construct
  misc_feature 1..4488: note = Cpf1 variant mRNA product
  source 1..4488: mol_type = other RNA
gggagagtcccgcagtcggcgtccagcggctctgcttgttcgtgtgtgtgtcgttgcaggccttattcaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt
